United States Patent 11,596,686 (CORONAVIRUS VACCINE) - sequence listing, part 13

SEQ ID NO: 24530 - RNA, 4035 nt, synthetic construct
  misc_feature 1..4035: note = SARS-CoV-2/Wuhan/WIV05/2019__EPI_ISL_402128 spike protein mRNA gc (1-1273)(N439K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24531 - RNA, 4035 nt, synthetic construct
  misc_feature 1..4035: note = SARS-CoV-2/Wuhan/WIV05/2019__EPI_ISL_402128 spike protein mRNA gc (1-1273)(S477N_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24532 - RNA, 4035 nt, synthetic construct
  misc_feature 1..4035: note = SARS-CoV-2/Wuhan/WIV05/2019__EPI_ISL_402128 spike protein mRNA gc (1-1273)(N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24533 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_D614G)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24534 - RNA, 4035 nt, synthetic construct
  misc_feature 1..4035: note = SARS-CoV-2/Wuhan/WIV05/2019__EPI_ISL_402128 spike protein mRNA gc (1-1273)(Y453F_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24535 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24536 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_M1229I)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24537 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24538 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_Y453F_D614G_I692V_M1229I)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24539 - RNA, 4026 nt, synthetic construct
  misc_feature 1..4026: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4026: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24540 - RNA, 4035 nt, synthetic construct
  misc_feature 1..4035: note = SARS-CoV-2/Wuhan/WIV05/2019__EPI_ISL_402128 spike protein mRNA gc (1-1273)(K417N_E484K_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24541 - RNA, 4026 nt, synthetic construct
  misc_feature 1..4026: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24542 - RNA, 4035 nt, synthetic construct
  misc_feature 1..4035: note = SARS-CoV-2/Wuhan/WIV05/2019__EPI_ISL_402128 spike protein mRNA gc (1-1273)(E484K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24543 - RNA, 4035 nt, synthetic construct
  misc_feature 1..4035: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24544 - RNA, 4035 nt, synthetic construct
  misc_feature 1..4035: note = SARS-CoV-2/Wuhan/WIV05/2019__EPI_ISL_402128 spike protein mRNA gc (1-1273)(S13I_W152C_L452R_D614G)
  source 1..4035: mol_type = other RNA
aggagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24545 - RNA, 4035 nt, synthetic construct
  misc_feature 1..4035: note = SARS-CoV-2/Wuhan/WIV05/2019__EPI_ISL_402128 spike protein mRNA gc (1-1273)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24546 - RNA, 4035 nt, synthetic construct
  misc_feature 1..4035: note = SARS-CoV-2/Wuhan/WIV05/2019__EPI_ISL_402128 spike protein mRNA gc (1-1273)(D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24547 - RNA, 4035 nt, synthetic construct
  misc_feature 1..4035: note = SARS-CoV-2/Wuhan/WIV05/2019__EPI_ISL_402128 spike protein mRNA gc (1-1273)(A222V_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24548 - RNA, 4035 nt, synthetic construct
  misc_feature 1..4035: note = SARS-CoV-2/Wuhan/WIV05/2019__EPI_ISL_402128 spike protein mRNA gc (1-1273)(N439K_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24549 - RNA, 4035 nt, synthetic construct
  misc_feature 1..4035: note = SARS-CoV-2/Wuhan/WIV05/2019__EPI_ISL_402128 spike protein mRNA gc (1-1273)(S477N_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24550 - RNA, 4035 nt, synthetic construct
  misc_feature 1..4035: note = SARS-CoV-2/Wuhan/WIV05/2019__EPI_ISL_402128 spike protein mRNA gc (1-1273)(N501Y_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24551 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_D614G)
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24552 - RNA, 4035 nt, synthetic construct
  misc_feature 1..4035: note = SARS-CoV-2/Wuhan/WIV05/2019__EPI_ISL_402128 spike protein mRNA gc (1-1273)(Y453F_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24553 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_I692V)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24554 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_M1229I)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24555 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24556 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_Y453F_D614G_I692V_M1229I)
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24557 - RNA, 4026 nt, synthetic construct
  misc_feature 1..4026: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4026: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24558 - RNA, 4035 nt, synthetic construct
  misc_feature 1..4035: note = SARS-CoV-2/Wuhan/WIV05/2019__EPI_ISL_402128 spike protein mRNA gc (1-1273)(K417N_E484K_N501Y_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24559 - RNA, 4026 nt, synthetic construct
  misc_feature 1..4026: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24560 - RNA, 4035 nt, synthetic construct
  misc_feature 1..4035: note = SARS-CoV-2/Wuhan/WIV05/2019__EPI_ISL_402128 spike protein mRNA gc (1-1273)(E484K_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24561 - RNA, 4035 nt, synthetic construct
  misc_feature 1..4035: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24562 - RNA, 4035 nt, synthetic construct
  misc_feature 1..4035: note = SARS-CoV-2/Wuhan/WIV05/2019__EPI_ISL_402128 spike protein mRNA gc (1-1273)(S13I_W152C_L452R_D614G)
  source 1..4035: mol_type = other RNA
aggagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24563 - RNA, 4035 nt, synthetic construct
  misc_feature 1..4035: note = SARS-CoV-2/Wuhan/WIV05/2019__EPI_ISL_402128 spike protein mRNA gc (1-1273)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggcgtgttcgtgagcaacggaacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgatgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24564 - RNA, 4035 nt, synthetic construct
  misc_feature 1..4035: note = SARS-CoV-2/Wuhan/WIV05/2019__EPI_ISL_402128 spike protein mRNA gc (1-1273)(D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24565 - RNA, 4035 nt, synthetic construct
  misc_feature 1..4035: note = SARS-CoV-2/Wuhan/WIV05/2019__EPI_ISL_402128 spike protein mRNA gc (1-1273)(A222V_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatttgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24566 - RNA, 4035 nt, synthetic construct
  misc_feature 1..4035: note = SARS-CoV-2/Wuhan/WIV05/2019__EPI_ISL_402128 spike protein mRNA gc (1-1273)(N439K_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24567 - RNA, 4035 nt, synthetic construct
  misc_feature 1..4035: note = SARS-CoV-2/Wuhan/WIV05/2019__EPI_ISL_402128 spike protein mRNA gc (1-1273)(S477N_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24568 - RNA, 4035 nt, synthetic construct
  misc_feature 1..4035: note = SARS-CoV-2/Wuhan/WIV05/2019__EPI_ISL_402128 spike protein mRNA gc (1-1273)(N501Y_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24569 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_D614G)
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtgacatacgtccccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24570 - RNA, 4035 nt, synthetic construct
  misc_feature 1..4035: note = SARS-CoV-2/Wuhan/WIV05/2019__EPI_ISL_402128 spike protein mRNA gc (1-1273)(Y453F_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24571 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_I692V)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24572 - RNA, 4035 nt, synthetic construct
  misc_feature 1..4035: note = SARS-CoV-2/Wuhan/WIV05/2019__EPI_ISL_402128 spike protein mRNA gc (1-1273)(D614G_M1229I)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24573 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgccccacacggcgtggtcttcctccacgtgacatacgtgcccgcccaggagaagaacttcaccaccgcccccgccatctgccacgacggcaaggcccacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24574 - RNA, 4029 nt, synthetic construct
  misc_feature 1..4029: note = SARS-CoV-2/Wuhan/WIV05/2019__EPI_ISL_402128 spike protein mRNA gc (1-1273)(H69del_V70del_Y453F_D614G_I692V_M1229I)
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24575 - RNA, 4026 nt, synthetic construct
  misc_feature 1..4026: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4026: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacaaggtggaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtcccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccccctgcagcccgagctggacagcttcaaggaggagctggacaagtacttcaagaaccacaccagccctgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24576 - RNA, 4035 nt, synthetic construct
  misc_feature 1..4035: note = SARS-CoV-2/Wuhan/WIV05/2019__EPI_ISL_402128 spike protein mRNA gc (1-1273)(K417N_E484K_N501Y_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24577 - RNA, 4026 nt, synthetic construct
  misc_feature 1..4026: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggacaaggtggaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgccccacacggcgtggtcttcctgcacgtgacatacgtgcccgcccaggagaagaacttcaccaccgcccccgccatctgccacgacggaaaggcccacttcccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctcgacaagtacttcaagaaccacaccagccccgacgtggacctgggcgacatcagcggcatcaacgctagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24578 - RNA, 4035 nt, synthetic construct
  misc_feature 1..4035: note = SARS-CoV-2/Wuhan/WIV05/2019__EPI_ISL_402128 spike protein mRNA gc (1-1273)(E484K_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24579 - RNA, 4035 nt, synthetic construct
  misc_feature 1..4035: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacaaggtggaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtcacctacgtgccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagccctgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24580 - RNA, 4035 nt, synthetic construct
  misc_feature 1..4035: note = SARS-CoV-2/Wuhan/WIV05/2019__EPI_ISL_402128 spike protein mRNA gc (1-1273)(S13I_W152C_L452R_D614G)
  source 1..4035: mol_type = other RNA
aggagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggacaaggtggaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgccccacacggcgtggtgttcctgcacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagccagtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24581 - RNA, 4035 nt, synthetic construct
  misc_feature 1..4035: note = SARS-CoV-2/Wuhan/WIV05/2019__EPI_ISL_402128 spike protein mRNA gc mod (1-1273)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24582 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24583 - RNA, 4035 nt, synthetic construct
  misc_feature 1..4035: note = SARS-CoV-2/Wuhan/WIV05/2019__EPI_ISL_402128 spike protein mRNA gc mod (1-1273)(A222V_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24584 - RNA, 4035 nt, synthetic construct
  misc_feature 1..4035: note = SARS-CoV-2/Wuhan/WIV05/2019__EPI_ISL_402128 spike protein mRNA gc mod (1-1273)(N439K_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24585 - RNA, 4035 nt, synthetic construct
  misc_feature 1..4035: note = SARS-CoV-2/Wuhan/WIV05/2019__EPI_ISL_402128 spike protein mRNA gc mod (1-1273)(S477N_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24586 - RNA, 4035 nt, synthetic construct
  misc_feature 1..4035: note = SARS-CoV-2/Wuhan/WIV05/2019__EPI_ISL_402128 spike protein mRNA gc mod (1-1273)(N501Y_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24587 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_D614G)
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24588 - RNA, 4035 nt, synthetic construct
  misc_feature 1..4035: note = SARS-CoV-2/Wuhan/WIV05/2019__EPI_ISL_402128 spike protein mRNA gc mod (1-1273)(Y453F_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24589 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G_I692V)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24590 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G_M1229I)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24591 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24592 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24593 - RNA, 4026 nt, synthetic construct
  misc_feature 1..4026: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4026: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24594 - RNA, 4035 nt, synthetic construct
  misc_feature 1..4035: note = SARS-CoV-2/Wuhan/WIV05/2019__EPI_ISL_402128 spike protein mRNA gc mod (1-1273)(K417N_E484K_N501Y_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24595 - RNA, 4026 nt, synthetic construct
  misc_feature 1..4026: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24596 - RNA, 4035 nt, synthetic construct
  misc_feature 1..4035: note = SARS-CoV-2/Wuhan/WIV05/2019__EPI_ISL_402128 spike protein mRNA gc mod (1-1273)(E484K_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24597 - RNA, 4035 nt, synthetic construct
  misc_feature 1..4035: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24598 - RNA, 4035 nt, synthetic construct
  misc_feature 1..4035: note = SARS-CoV-2/Wuhan/WIV05/2019__EPI_ISL_402128 spike protein mRNA gc mod (1-1273)(S13I_W152C_L452R_D614G)
  source 1..4035: mol_type = other RNA
aggagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24599 - RNA, 4035 nt, synthetic construct
  misc_feature 1..4035: note = SARS-CoV-2/Wuhan/WIV05/2019__EPI_ISL_402128 spike protein mRNA gc mod (1-1273)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24600 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24601 - RNA, 4035 nt, synthetic construct
  misc_feature 1..4035: note = SARS-CoV-2/Wuhan/WIV05/2019__EPI_ISL_402128 spike protein mRNA gc mod (1-1273)(A222V_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24602 - RNA, 4035 nt, synthetic construct
  misc_feature 1..4035: note = SARS-CoV-2/Wuhan/WIV05/2019__EPI_ISL_402128 spike protein mRNA gc mod (1-1273)(N439K_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24603 - RNA, 4035 nt, synthetic construct
  misc_feature 1..4035: note = SARS-CoV-2/Wuhan/WIV05/2019__EPI_ISL_402128 spike protein mRNA gc mod (1-1273)(S477N_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24604 - RNA, 4035 nt, synthetic construct
  misc_feature 1..4035: note = SARS-CoV-2/Wuhan/WIV05/2019__EPI_ISL_402128 spike protein mRNA gc mod (1-1273)(N501Y_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24605 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_D614G)
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24606 - RNA, 4035 nt, synthetic construct
  misc_feature 1..4035: note = SARS-CoV-2/Wuhan/WIV05/2019__EPI_ISL_402128 spike protein mRNA gc mod (1-1273)(Y453F_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24607 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G_I692V)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24608 - RNA, 4035 nt, synthetic construct
  misc_feature 1..4035: note = SARS-CoV-2/Wuhan/WIV05/2019__EPI_ISL_402128 spike protein mRNA gc mod (1-1273)(D614G_M1229I)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24609 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24610 - RNA, 4029 nt, synthetic construct
  misc_feature 1..4029: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24611 - RNA, 4026 nt, synthetic construct
  misc_feature 1..4026: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4026: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24612 - RNA, 4035 nt, synthetic construct
  misc_feature 1..4035: note = SARS-CoV-2/Wuhan/WIV05/2019__EPI_ISL_402128 spike protein mRNA gc mod (1-1273)(K417N_E484K_N501Y_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24613 - RNA, 4026 nt, synthetic construct
  misc_feature 1..4026: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4026: mol_type = other RNA
aggagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24614 - RNA, 4035 nt, synthetic construct
  misc_feature 1..4035: note = SARS-CoV-2/Wuhan/WIV05/2019__EPI_ISL_402128 spike protein mRNA gc mod (1-1273)(E484K_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24615 - RNA, 4035 nt, synthetic construct
  misc_feature 1..4035: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4035: mol_type = other RNA
aggagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24616 - RNA, 4035 nt, synthetic construct
  misc_feature 1..4035: note = SARS-CoV-2/Wuhan/WIV05/2019__EPI_ISL_402128 spike protein mRNA gc mod (1-1273)(S13I_W152C_L452R_D614G)
  source 1..4035: mol_type = other RNA
aggagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24617 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24618 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_ D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24619 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_A222V_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24620 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N439K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24621 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_S477N_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24622 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24623 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_D614G)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24624 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_Y453F_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24625 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24626 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_M1229I)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24627 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24628 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24629 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24630 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24631 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24632 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_E484K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24633 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24634 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4035: mol_type = other RNA
aggagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24635 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgcgccccacggcgtggtgttcctccacgtcacgtacgtgcccgcccaggagaagaacttcaccaccgccccggccatctgccacgacgggaaggcccacttcccccgcgagggcgtcttcgtgtccaacgggacccactggttcgtgacgcagcggaacttctacgagccccagatcatcaccaccgacaacaccttcgtcagcggcaactgcgacgtggtgatcggcatcgtcaacaacacggtgtacgaccccctgcagccggagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccctggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagccggtgctgaagggggtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24636 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_ D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24637 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_A222V_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggccgcggagatccgcgccagcgccaacctcgccgccaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcgcacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgccatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24638 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N439K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24639 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_S477N_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacccgcccgaggccgaggtccagatcgaccggctgatcaccggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacgtacgtgcccgcccaggagaagaacttcaccaccgccccggccatctgccacgacggcaaggcccacttcccccgcgagggggtcttcgtgagcaacggcacccactggttcgtgacgcagcggaacttctacgagccccagatcatcaccaccgacaacaccttcgtctccggcaactgcgacgtggtgatcgggatcgtcaacaacacggtgtacgaccccctgcagccggagctggacagcttcaaggaggagctcgacaagtacttcaagaaccacacctcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24640 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24641 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_D614G)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacccgcccgaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgcgccccacggggtcgtgttcctccacgtgacgtacgtccccgcccaggagaagaacttcaccaccgccccggccatctgccacgacggcaaggcccacttcccccgcgagggggtgttcgtctccaacggcacccactggttcgtgacgcagcggaacttctacgagccccagatcatcaccaccgacaacaccttcgtgagcggcaactgcgacgtcgtgatcgggatcgtgaacaacacggtctacgaccccctgcagccggagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagccggtgctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24642 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_Y453F_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24643 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_I692V)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcccacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24644 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_M1229I)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24645 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacccgcccgaggccgaggtgcagatcgaccggctgatcaccggccgcctccagtccctgcagacctacgtgacccagcagctgatccgggccgcggagatccgcgccagcgccaacctcgccgccaccaagatgagcgagtgcgtcctgggccagtccaagcgggtggacttctgcgggaagggctaccacctgatgagcttcccccagtccgcgccccacggggtggtcttcctccacgtgacgtacgtccccgcccaggagaagaacttcaccaccgccccggccatctgccacgacggcaaggcgcacttcccccgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagccggagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24646 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4029: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24647 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacccgcccgaggccgaggtgcagatcgaccggctgatcacgggccgcctccagtccctgcagacctacgtcacccagcagctgatccgggcggccgagatccgcgccagcgccaacctcgccgcgaccaagatgagcgagtgcgtgctgggccagtccaagcgggtggacttctgcgggaagggctaccacctgatgagcttcccccagtccgcgccccacggggtcgtgttcctccacgtgacctacgtccccgcccaggagaagaacttcacgaccgcccccgccatctgccacgacggcaaggcccacttcccgcgcgagggggtgttcgtcagcaacggcacccactggttcgtgacccagcggaacttctacgagccccagatcatcacgacccacaacaccttcgtgtccggcaactgcgacgtcgtgatcgggatcgtgaacaacaccgtctacgaccccctgcagcccgagctggacagcttcaaggaggagctcgacaagtacttcaagaaccacacgtccccggacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24648 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24649 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacccgcccgaggccgaggtgcagatcgaccgcctgatcaccggccggctccagagcctgcagacctacgtgacccagcagctgatccgcgccgcggagatccgggccagcgccaacctcgccgccaccaagatgtccgagtgcgtcctggggcagagcaagcgcgtggacttctgcggcaaggggtaccacctgatgtccttcccccagagcgcgccccacggcgtggtcttcctccacgtgacgtacgtccccgcccaggagaagaacttcaccaccgccccggccatctgccacgacgggaaggcgcacttcccccgggagggcgtgttcgtgtccaacggcacccactggttcgtcacgcagcgcaacttctacgagccccagatcatcaccaccgacaacaccttcgtgagcgggaactgcgacgtggtcatcggcatcgtgaacaacacggtgtacgaccccctgcagccggagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcggcaagtacgagcagtacatcaagtggccctggtacatctggctggggttcatcgccggcctgatcgccatcgtgatggtgaccatcatgctctgctgcatgaccagctgctgctcctgcctgaaggggtgctgcagctgcggctcctgctgcaagttcgacgaggacgacagcgagccggtcctgaagggggtgaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24650 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_E484K_D614G)
  source 1..4035: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24651 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgatcaagatgtccgagtgcgtgctcggccagagcaagcgcgtcgacttctgcgggaagggctaccacctgatgtccttcccccagagcgcgccccacggggtggtgttcctgcacgtcacctacgtgcccgcccaggagaagaacttcacgaccgcccccgccatctgccacgacggcaaggcccacttcccgcgggagggggtcttcgtgtccaacggcacccactggttcgtgacccagcgcaacttctacgagccccagatcatcacgaccgacaacaccttcgtcagcggcaactgcgacgtggtgatcgggatcgtcaacaacaccgtgtacgaccccctccagcccgagctggactccttcaaggaggagctggacaagtacttcaagaaccacacgagcccggacgtggacctcggcgacatctccgggatcaacgccagcgtcgtgaacatccagaaggagatcgaccggctgaacgaggtggccaagaacctgaacgagtccctcatcgacctgcaggagctgggcaagtacgagcagtacatcaagtggccctggtacatctggctcggcttcatcgccgggctgatcgcgatcgtcatggtgaccatcatgctgtgctgcatgaccagctgctgctcctgcctcaagggctgctgcagctgcgggtcctgctgcaagttcgacgaggacgacagcgagcccgtgctgaagggcgtcaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24652 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4035: mol_type = other RNA
aggagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgaccaagatgagcgagtgcgtgctcggccagtccaagcgcgtcgacttctgcgggaagggctaccacctgatgagcttcccccagtccgcgccccacggggtggtgttcctgcacgtcacgtacgtgcccgcccaggagaagaacttcaccaccgccccggccatctgccacgacggcaaggcccacttcccccgggagggggtcttcgtgagcaacggcacccactggttcgtgacgcagcgcaacttctacgagccccagatcatcaccaccgacaacaccttcgtctccggcaactgcgacgtggtgatcgggatcgtcaacaacacggtgtacgaccccctccagccggagctggacagcttcaaggaggagctggacaagtacttcaagaaccacacctcccccgacgtggacctcggcgacatcagcgggatcaacgcctccgtcgtgaacatccagaaggagatcgaccggctgaacgaggtggccaagaacctgaacgagagcctcatcgacctgcaggagctgggcaagtacgagcagtacatcaagtggccctggtacatctggctcggcttcatcgccgggctgatcgcgatcgtcatggtgaccatcatgctgtgctgcatgacctcctgctgcagctgcctcaagggctgctgctcctgcgggagctgctgcaagttcgacgaggacgactccgagccggtgctgaagggcgtcaagctgcactacacgtgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24653 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24654 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_ D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24655 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_A222V_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24656 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N439K_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24657 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_S477N_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24658 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N501Y_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24659 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_D614G)
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24660 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_Y453F_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24661 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_I692V)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24662 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_M1229I)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24663 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24664 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4029: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24665 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24666 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24667 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24668 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_E484K_D614G)
  source 1..4035: mol_type = other RNA
aggagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24669 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24670 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4035: mol_type = other RNA
aggagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24671 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggcgtgttcgtgagcaacggaacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24672 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_ D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24673 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_A222V_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24674 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N439K_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24675 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_S477N_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24676 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_N501Y_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24677 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_D614G)
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtgcccgcccaggagaagaacttcaccaccgcccccgccatttgccacgacggcaaggcccacttcccccgggagggagtcttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24678 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_Y453F_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24679 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_I692V)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24680 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_D614G_M1229I)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24681 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24682 - RNA, 4029 nt, synthetic construct
  misc_feature 1..4029: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4029: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24683 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacccacccgaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtgcccgcccaggagaagaacttcacaaccgcccccgccatctgccacgacggcaaggcccacttcccccgggagggagtcttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccctctgcagcccgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24684 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24685 - RNA, 4026 nt, synthetic construct
  misc_feature 1..4026: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggatcccccagaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgctccccacggcgtggtgttcctgcacgtcacatacgtgcccgcccaggagaagaacttcaccaccgcccccgccatctgccacgacggaaaggcccacttcccccgggagggcgtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctcgacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24686 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_E484K_D614G)
  source 1..4035: mol_type = other RNA
aggagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24687 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacccacccgaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtgacctacgtccccgcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccctctccagcccgagctggacagcttcaaggaggagctggacaagtacttcaagaaccacaccagccccgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24688 - RNA, 4035 nt, synthetic construct
  misc_feature 1..4035: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4035: mol_type = other RNA
aggagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggatcccccagaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgctccccacggcgtggtgttcctgcacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagcccgtgctgaagggcgtgaagctgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24689 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24690 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_ D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24691 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_A222V_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24692 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_N439K_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24693 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_S477N_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24694 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_N501Y_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24695 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_D614G)
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24696 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_Y453F_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24697 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_D614G_I692V)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24698 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_D614G_M1229I)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24699 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24700 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4029: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24701 - RNA, 4026 nt, synthetic construct
  misc_feature 1..4026: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24702 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24703 - RNA, 4026 nt, synthetic construct
  misc_feature 1..4026: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24704 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_E484K_D614G)
  source 1..4035: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24705 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24706 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4035: mol_type = other RNA
aggagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24707 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24708 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_ D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24709 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_A222V_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24710 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_N439K_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24711 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_S477N_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24712 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_N501Y_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24713 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_D614G)
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24714 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_Y453F_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24715 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_D614G_I692V)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24716 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_D614G_M1229I)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24717 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24718 - RNA, 4029 nt, synthetic construct
  misc_feature 1..4029: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4029: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24719 - RNA, 4026 nt, synthetic construct
  misc_feature 1..4026: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4026: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24720 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24721 - RNA, 4026 nt, synthetic construct
  misc_feature 1..4026: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4026: mol_type = other RNA
aggagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24722 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_E484K_D614G)
  source 1..4035: mol_type = other RNA
aggagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24723 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4035: mol_type = other RNA
aggagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24724 - RNA, 4035 nt, synthetic construct
  misc_feature 1..4035: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4035: mol_type = other RNA
aggagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagttataagactgactagcccgatgggcctcccaacgggccctcctcccctccttgcaccgagagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24725 - RNA, 1400 nt, synthetic construct
  misc_feature 1..1400: note = SARS-CoV-2/Wuhan/WIV05/2019__EPI_ISL_402128 spike protein mRNA gc (1-15,334-528) Ferritin construct
  source 1..1400: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24726 - RNA, 998 nt, synthetic construct
  misc_feature 1..998: note = SARS-CoV-2/Wuhan/WIV05/2019__EPI_ISL_402128 spike protein mRNA gc (334-528) Foldon construct
  source 1..998: mol_type = other RNA
aggagagtcccgcagtcggcgtccagcggctctgcttgttcgtgtgtgtgtcgttgcaggccttattcaagcttaccatgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24727 - RNA, 1376 nt, synthetic construct
  misc_feature 1..1376: note = SARS-CoV-2/Wuhan/WIV05/2019__EPI_ISL_402128 spike protein mRNA gc (1-15,334-528) LumSynth construct
  source 1..1376: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24728 - RNA, 1337 nt, synthetic construct
  misc_feature 1..1337: note = SARS-CoV-2/Wuhan/WIV05/2019__EPI_ISL_402128 spike protein mRNA gc (334-528) LumSynth construct
  source 1..1337: mol_type = other RNA
aggagagtcccgcagtcggcgtccagcggctctgcttgttcgtgtgtgtgtcgttgcaggccttattcaagcttaccatgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24729 - RNA, 4070 nt, synthetic construct
  misc_feature 1..4070: note = SARS-CoV-2/Wuhan/WIV05/2019__EPI_ISL_402128 spike protein mRNA gc (1-1273)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24730 - RNA, 4070 nt, synthetic construct
  misc_feature 1..4070: note = SARS-CoV-2/Wuhan/WIV05/2019__EPI_ISL_402128 spike protein mRNA gc (1-1273)(D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24731 - RNA, 4070 nt, synthetic construct
  misc_feature 1..4070: note = SARS-CoV-2/Wuhan/WIV05/2019__EPI_ISL_402128 spike protein mRNA gc (1-1273)(A222V_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24732 - RNA, 4070 nt, synthetic construct
  misc_feature 1..4070: note = SARS-CoV-2/Wuhan/WIV05/2019__EPI_ISL_402128 spike protein mRNA gc (1-1273)(N439K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24733 - RNA, 4070 nt, synthetic construct
  misc_feature 1..4070: note = SARS-CoV-2/Wuhan/WIV05/2019__EPI_ISL_402128 spike protein mRNA gc (1-1273)(S477N_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24734 - RNA, 4070 nt, synthetic construct
  misc_feature 1..4070: note = SARS-CoV-2/Wuhan/WIV05/2019__EPI_ISL_402128 spike protein mRNA gc (1-1273)(N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24735 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24736 - RNA, 4070 nt, synthetic construct
  misc_feature 1..4070: note = SARS-CoV-2/Wuhan/WIV05/2019__EPI_ISL_402128 spike protein mRNA gc (1-1273)(Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24737 - RNA, 4070 nt, synthetic construct
  misc_feature 1..4070: note = SARS-CoV-2/Wuhan/WIV05/2019__EPI_ISL_402128 spike protein mRNA gc (1-1273)(D614G_I692V)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24738 - RNA, 4070 nt, synthetic construct
  misc_feature 1..4070: note = SARS-CoV-2/Wuhan/WIV05/2019__EPI_ISL_402128 spike protein mRNA gc (1-1273)(D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24739 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24740 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_Y453F_D614G_I692V_M1229I)
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24741 - RNA, 4061 nt, synthetic construct
  misc_feature 1..4061: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24742 - RNA, 4070 nt, synthetic construct
  misc_feature 1..4070: note = SARS-CoV-2/Wuhan/WIV05/2019__EPI_ISL_402128 spike protein mRNA gc (1-1273)(K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24743 - RNA, 4061 nt, synthetic construct
  misc_feature 1..4061: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24744 - RNA, 4070 nt, synthetic construct
  misc_feature 1..4070: note = SARS-CoV-2/Wuhan/WIV05/2019__EPI_ISL_402128 spike protein mRNA gc (1-1273)(E484K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24745 - RNA, 4070 nt, synthetic construct
  misc_feature 1..4070: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24746 - RNA, 4070 nt, synthetic construct
  misc_feature 1..4070: note = SARS-CoV-2/Wuhan/WIV05/2019__EPI_ISL_402128 spike protein mRNA gc (1-1273)(S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24747 - RNA, 4070 nt, synthetic construct; identical to SEQ ID NO: 24729
  misc_feature 1..4070: note = SARS-CoV-2/Wuhan/WIV05/2019__EPI_ISL_402128 spike protein mRNA gc (1-1273)
  source 1..4070: mol_type = other RNA

SEQ ID NO: 24748 - RNA, 4070 nt, synthetic construct
  misc_feature 1..4070: note = SARS-CoV-2/Wuhan/WIV05/2019__EPI_ISL_402128 spike protein mRNA gc (1-1273)(D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24749 - RNA, 4070 nt, synthetic construct
  misc_feature 1..4070: note = SARS-CoV-2/Wuhan/WIV05/2019__EPI_ISL_402128 spike protein mRNA gc (1-1273)(A222V_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24750 - RNA, 4070 nt, synthetic construct
  misc_feature 1..4070: note = SARS-CoV-2/Wuhan/WIV05/2019__EPI_ISL_402128 spike protein mRNA gc (1-1273)(N439K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24751 - RNA, 4070 nt, synthetic construct
  misc_feature 1..4070: note = SARS-CoV-2/Wuhan/WIV05/2019__EPI_ISL_402128 spike protein mRNA gc (1-1273)(S477N_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24752 - RNA, 4070 nt, synthetic construct
  misc_feature 1..4070: note = SARS-CoV-2/Wuhan/WIV05/2019__EPI_ISL_402128 spike protein mRNA gc (1-1273)(N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24753 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24754 - RNA, 4070 nt, synthetic construct
  misc_feature 1..4070: note = SARS-CoV-2/Wuhan/WIV05/2019__EPI_ISL_402128 spike protein mRNA gc (1-1273)(Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24755 - RNA, 4070 nt, synthetic construct
  misc_feature 1..4070: note = SARS-CoV-2/Wuhan/WIV05/2019__EPI_ISL_402128 spike protein mRNA gc (1-1273)(D614G_I692V)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24756 - RNA, 4070 nt, synthetic construct
  misc_feature 1..4070: note = SARS-CoV-2/Wuhan/WIV05/2019__EPI_ISL_402128 spike protein mRNA gc (1-1273)(D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24757 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24758 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_Y453F_D614G_I692V_M1229I)
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24759 - RNA, 4061 nt, synthetic construct
  misc_feature 1..4061: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24760 - RNA, 4070 nt, synthetic construct
  misc_feature 1..4070: note = SARS-CoV-2/Wuhan/WIV05/2019__EPI_ISL_402128 spike protein mRNA gc (1-1273)(K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24761 - RNA, 4061 nt, synthetic construct
  misc_feature 1..4061: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24762 - RNA, 4070 nt, synthetic construct
  misc_feature 1..4070: note = SARS-CoV-2/Wuhan/WIV05/2019__EPI_ISL_402128 spike protein mRNA gc (1-1273)(E484K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24763 - RNA, 4070 nt, synthetic construct
  misc_feature 1..4070: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24764 - RNA, 4070 nt, synthetic construct
  misc_feature 1..4070: note = SARS-CoV-2/Wuhan/WIV05/2019__EPI_ISL_402128 spike protein mRNA gc (1-1273)(S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24765 - RNA, 4070 nt, synthetic construct
  misc_feature 1..4070: note = SARS-CoV-2/Wuhan/WIV05/2019__EPI_ISL_402128 spike protein mRNA gc (1-1273)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24766 - RNA, 4070 nt, synthetic construct
  misc_feature 1..4070: note = SARS-CoV-2/Wuhan/WIV05/2019__EPI_ISL_402128 spike protein mRNA gc (1-1273)(D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24767 - RNA, 4070 nt, synthetic construct
  misc_feature 1..4070: note = SARS-CoV-2/Wuhan/WIV05/2019__EPI_ISL_402128 spike protein mRNA gc (1-1273)(A222V_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24768 - RNA, 4070 nt, synthetic construct
  misc_feature 1..4070: note = SARS-CoV-2/Wuhan/WIV05/2019__EPI_ISL_402128 spike protein mRNA gc (1-1273)(N439K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24769 - RNA, 4070 nt, synthetic construct
  misc_feature 1..4070: note = SARS-CoV-2/Wuhan/WIV05/2019__EPI_ISL_402128 spike protein mRNA gc (1-1273)(S477N_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24770 - RNA, 4070 nt, synthetic construct
  misc_feature 1..4070: note = SARS-CoV-2/Wuhan/WIV05/2019__EPI_ISL_402128 spike protein mRNA gc (1-1273)(N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24771 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24772 - RNA, 4070 nt, synthetic construct
  misc_feature 1..4070: note = SARS-CoV-2/Wuhan/WIV05/2019__EPI_ISL_402128 spike protein mRNA gc (1-1273)(Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24773 - RNA, 4070 nt, synthetic construct
  misc_feature 1..4070: note = SARS-CoV-2/Wuhan/WIV05/2019__EPI_ISL_402128 spike protein mRNA gc (1-1273)(D614G_I692V)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24774 - RNA, 4070 nt, synthetic construct
  misc_feature 1..4070: note = SARS-CoV-2/Wuhan/WIV05/2019__EPI_ISL_402128 spike protein mRNA gc (1-1273)(D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24775 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24776 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_Y453F_D614G_I692V_M1229I)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24777 - RNA, 4061 nt, synthetic construct
  misc_feature 1..4061: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24778 - RNA, 4070 nt, synthetic construct
  misc_feature 1..4070: note = SARS-CoV-2/Wuhan/WIV05/2019__EPI_ISL_402128 spike protein mRNA gc (1-1273)(K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24779 - RNA, 4061 nt, synthetic construct
  misc_feature 1..4061: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24780 - RNA, 4070 nt, synthetic construct
  misc_feature 1..4070: note = SARS-CoV-2/Wuhan/WIV05/2019__EPI_ISL_402128 spike protein mRNA gc (1-1273)(E484K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24781 - RNA, 4070 nt, synthetic construct
  misc_feature 1..4070: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24782 - RNA, 4070 nt, synthetic construct
  misc_feature 1..4070: note = SARS-CoV-2/Wuhan/WIV05/2019__EPI_ISL_402128 spike protein mRNA gc (1-1273)(S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24783 - RNA, 4070 nt, synthetic construct
  misc_feature 1..4070: note = SARS-CoV-2/Wuhan/WIV05/2019__EPI_ISL_402128 spike protein mRNA gc (1-1273)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggcgtgttcgtgagcaacggaacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgatgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24784 - RNA, 4070 nt, synthetic construct
  misc_feature 1..4070: note = SARS-CoV-2/Wuhan/WIV05/2019__EPI_ISL_402128 spike protein mRNA gc (1-1273)(D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24785 - RNA, 4070 nt, synthetic construct
  misc_feature 1..4070: note = SARS-CoV-2/Wuhan/WIV05/2019__EPI_ISL_402128 spike protein mRNA gc (1-1273)(A222V_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatttgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24786 - RNA, 4070 nt, synthetic construct
  misc_feature 1..4070: note = SARS-CoV-2/Wuhan/WIV05/2019__EPI_ISL_402128 spike protein mRNA gc (1-1273)(N439K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24787 - RNA, 4070 nt, synthetic construct
  misc_feature 1..4070: note = SARS-CoV-2/Wuhan/WIV05/2019__EPI_ISL_402128 spike protein mRNA gc (1-1273)(S477N_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24788 - RNA, 4070 nt, synthetic construct
  misc_feature 1..4070: note = SARS-CoV-2/Wuhan/WIV05/2019__EPI_ISL_402128 spike protein mRNA gc (1-1273)(N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24789 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtgacatacgtccccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24790 - RNA, 4070 nt, synthetic construct
  misc_feature 1..4070: note = SARS-CoV-2/Wuhan/WIV05/2019__EPI_ISL_402128 spike protein mRNA gc (1-1273)(Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24791 - RNA, 4070 nt, synthetic construct
  misc_feature 1..4070: note = SARS-CoV-2/Wuhan/WIV05/2019__EPI_ISL_402128 spike protein mRNA gc (1-1273)(D614G_I692V)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24792 - RNA, 4070 nt, synthetic construct
  misc_feature 1..4070: note = SARS-CoV-2/Wuhan/WIV05/2019__EPI_ISL_402128 spike protein mRNA gc (1-1273)(D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24793 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgccccacacggcgtggtcttcctccacgtgacatacgtgcccgcccaggagaagaacttcaccaccgcccccgccatctgccacgacggcaaggcccacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24794 - RNA, 4064 nt, synthetic construct
  misc_feature 1..4064: note = SARS-CoV-2/Wuhan/WIV05/2019__EPI_ISL_402128 spike protein mRNA gc (1-1273)(H69del_V70del_Y453F_D614G_I692V_M1229I)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24795 - RNA, 4061 nt, synthetic construct
  misc_feature 1..4061: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacaaggtggaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtcccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccccctgcagcccgagctggacagcttcaaggaggagctggacaagtacttcaagaaccacaccagccctgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24796 - RNA, 4070 nt, synthetic construct
  misc_feature 1..4070: note = SARS-CoV-2/Wuhan/WIV05/2019__EPI_ISL_402128 spike protein mRNA gc (1-1273)(K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24797 - RNA, 4061 nt, synthetic construct
  misc_feature 1..4061: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggacaaggtggaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgccccacacggcgtggtcttcctgcacgtgacatacgtgcccgcccaggagaagaacttcaccaccgcccccgccatctgccacgacggaaaggcccacttcccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctcgacaagtacttcaagaaccacaccagccccgacgtggacctgggcgacatcagcggcatcaacgctagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24798 - RNA, 4070 nt, synthetic construct
  misc_feature 1..4070: note = SARS-CoV-2/Wuhan/WIV05/2019__EPI_ISL_402128 spike protein mRNA gc (1-1273)(E484K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24799 - RNA, 4070 nt, synthetic construct
  misc_feature 1..4070: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacaaggtggaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtcacctacgtgccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagccctgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24800 - RNA, 4070 nt, synthetic construct
  misc_feature 1..4070: note = SARS-CoV-2/Wuhan/WIV05/2019__EPI_ISL_402128 spike protein mRNA gc (1-1273)(S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggacaaggtggaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgccccacacggcgtggtgttcctgcacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24801 - RNA, 4070 nt, synthetic construct
  misc_feature 1..4070: note = SARS-CoV-2/Wuhan/WIV05/2019__EPI_ISL_402128 spike protein mRNA gc mod (1-1273)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24802 - RNA, 4070 nt, synthetic construct
  misc_feature 1..4070: note = SARS-CoV-2/Wuhan/WIV05/2019__EPI_ISL_402128 spike protein mRNA gc mod (1-1273)(D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24803 - RNA, 4070 nt, synthetic construct
  misc_feature 1..4070: note = SARS-CoV-2/Wuhan/WIV05/2019__EPI_ISL_402128 spike protein mRNA gc mod (1-1273)(A222V_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24804 - RNA, 4070 nt, synthetic construct
  misc_feature 1..4070: note = SARS-CoV-2/Wuhan/WIV05/2019__EPI_ISL_402128 spike protein mRNA gc mod (1-1273)(N439K_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24805 - RNA, 4070 nt, synthetic construct
  misc_feature 1..4070: note = SARS-CoV-2/Wuhan/WIV05/2019__EPI_ISL_402128 spike protein mRNA gc mod (1-1273)(S477N_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24806 - RNA, 4070 nt, synthetic construct
  misc_feature 1..4070: note = SARS-CoV-2/Wuhan/WIV05/2019__EPI_ISL_402128 spike protein mRNA gc mod (1-1273)(N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24807 - RNA, 4064 nt, synthetic construct
  misc_feature 1..4064: note = SARS-CoV-2/Wuhan/WIV05/2019__EPI_ISL_402128 spike protein mRNA gc mod (1-1273)(H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24808 - RNA, 4070 nt, synthetic construct
  misc_feature 1..4070: note = SARS-CoV-2/Wuhan/WIV05/2019__EPI_ISL_402128 spike protein mRNA gc mod (1-1273)(Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24809 - RNA, 4070 nt, synthetic construct
  misc_feature 1..4070: note = SARS-CoV-2/Wuhan/WIV05/2019__EPI_ISL_402128 spike protein mRNA gc mod (1-1273)(D614G_I692V)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24810 - RNA, 4070 nt, synthetic construct
  misc_feature 1..4070: note = SARS-CoV-2/Wuhan/WIV05/2019__EPI_ISL_402128 spike protein mRNA gc mod (1-1273)(D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24811 - RNA, 4064 nt, synthetic construct
  misc_feature 1..4064: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4064: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24812 - RNA, 4064 nt, synthetic construct
  misc_feature 1..4064: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4064: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24813 - RNA, 4061 nt, synthetic construct
  misc_feature 1..4061: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24814 - RNA, 4070 nt, synthetic construct
  misc_feature 1..4070: note = SARS-CoV-2/Wuhan/WIV05/2019__EPI_ISL_402128 spike protein mRNA gc mod (1-1273)(K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24815 - RNA, 4061 nt, synthetic construct
  misc_feature 1..4061: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24816 - RNA, 4070 nt, synthetic construct
  misc_feature 1..4070: note = SARS-CoV-2/Wuhan/WIV05/2019__EPI_ISL_402128 spike protein mRNA gc mod (1-1273)(E484K_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24817 - RNA, 4070 nt, synthetic construct
  misc_feature 1..4070: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24818 - RNA, 4070 nt, synthetic construct
  misc_feature 1..4070: note = SARS-CoV-2/Wuhan/WIV05/2019__EPI_ISL_402128 spike protein mRNA gc mod (1-1273)(S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24819 - RNA, 4070 nt, synthetic construct
  misc_feature 1..4070: note = SARS-CoV-2/Wuhan/WIV05/2019__EPI_ISL_402128 spike protein mRNA gc mod (1-1273)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24820 - RNA, 4070 nt, synthetic construct
  misc_feature 1..4070: note = SARS-CoV-2/Wuhan/WIV05/2019__EPI_ISL_402128 spike protein mRNA gc mod (1-1273)(D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24821 - RNA, 4070 nt, synthetic construct
  misc_feature 1..4070: note = SARS-CoV-2/Wuhan/WIV05/2019__EPI_ISL_402128 spike protein mRNA gc mod (1-1273)(A222V_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24822 - RNA, 4070 nt, synthetic construct
  misc_feature 1..4070: note = SARS-CoV-2/Wuhan/WIV05/2019__EPI_ISL_402128 spike protein mRNA gc mod (1-1273)(N439K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24823 - RNA, 4070 nt, synthetic construct
  misc_feature 1..4070: note = SARS-CoV-2/Wuhan/WIV05/2019__EPI_ISL_402128 spike protein mRNA gc mod (1-1273)(S477N_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24824 - RNA, 4070 nt, synthetic construct
  misc_feature 1..4070: note = SARS-CoV-2/Wuhan/WIV05/2019__EPI_ISL_402128 spike protein mRNA gc mod (1-1273)(N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24825 - RNA, 4064 nt, synthetic construct
  misc_feature 1..4064: note = SARS-CoV-2/Wuhan/WIV05/2019__EPI_ISL_402128 spike protein mRNA gc mod (1-1273)(H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24826 - RNA, 4070 nt, synthetic construct
  misc_feature 1..4070: note = SARS-CoV-2/Wuhan/WIV05/2019__EPI_ISL_402128 spike protein mRNA gc mod (1-1273)(Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24827 - RNA, 4070 nt, synthetic construct
  misc_feature 1..4070: note = SARS-CoV-2/Wuhan/WIV05/2019__EPI_ISL_402128 spike protein mRNA gc mod (1-1273)(D614G_I692V)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24828 - RNA, 4070 nt, synthetic construct
  misc_feature 1..4070: note = SARS-CoV-2/Wuhan/WIV05/2019__EPI_ISL_402128 spike protein mRNA gc mod (1-1273)(D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24829 - RNA, 4064 nt, synthetic construct
  misc_feature 1..4064: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24830 - RNA, 4064 nt, synthetic construct
  misc_feature 1..4064: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24831 - RNA, 4061 nt, synthetic construct
  misc_feature 1..4061: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24832 - RNA, 4070 nt, synthetic construct
  misc_feature 1..4070: note = SARS-CoV-2/Wuhan/WIV05/2019__EPI_ISL_402128 spike protein mRNA gc mod (1-1273)(K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24833 - RNA, 4061 nt, synthetic construct
  misc_feature 1..4061: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24834 - RNA, 4070 nt, synthetic construct
  misc_feature 1..4070: note = SARS-CoV-2/Wuhan/WIV05/2019__EPI_ISL_402128 spike protein mRNA gc mod (1-1273)(E484K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24835 - RNA, 4070 nt, synthetic construct
  misc_feature 1..4070: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24836 - RNA, 4070 nt, synthetic construct
  misc_feature 1..4070: note = SARS-CoV-2/Wuhan/WIV05/2019__EPI_ISL_402128 spike protein mRNA gc mod (1-1273)(S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24837 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P) R10153
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24838 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_ D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24839 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_A222V_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24840 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_N439K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24841 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_S477N_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24842 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24843 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24844 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24845 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_D614G_I692V)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24846 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24847 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24848 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24849 - RNA, 4061 nt, synthetic construct
  misc_feature 1..4061: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24850 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24851 - RNA, 4061 nt, synthetic construct
  misc_feature 1..4061: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24852 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_E484K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24853 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24854 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24855 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgcgccccacggcgtggtgttcctccacgtcacgtacgtgcccgcccaggagaagaacttcaccaccgccccggccatctgccacgacgggaaggcccacttcccccgcgagggcgtcttcgtgtccaacgggacccactggttcgtgacgcagcggaacttctacgagccccagatcatcaccaccgacaacaccttcgtcagcggcaactgcgacgtggtgatcggcatcgtcaacaacacggtgtacgaccccctgcagccggagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccctggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagccggtgctgaagggggtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24856 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_ D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24857 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_A222V_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggccgcggagatccgcgccagcgccaacctcgccgccaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcgcacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgccatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24858 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_N439K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24859 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_S477N_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacccgcccgaggccgaggtccagatcgaccggctgatcaccggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacgtacgtgcccgcccaggagaagaacttcaccaccgccccggccatctgccacgacggcaaggcccacttcccccgcgagggggtcttcgtgagcaacggcacccactggttcgtgacgcagcggaacttctacgagccccagatcatcaccaccgacaacaccttcgtctccggcaactgcgacgtggtgatcgggatcgtcaacaacacggtgtacgaccccctgcagccggagctggacagcttcaaggaggagctcgacaagtacttcaagaaccacacctcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24860 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24861 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacccgcccgaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgcgccccacggggtcgtgttcctccacgtgacgtacgtccccgcccaggagaagaacttcaccaccgccccggccatctgccacgacggcaaggcccacttcccccgcgagggggtgttcgtctccaacggcacccactggttcgtgacgcagcggaacttctacgagccccagatcatcaccaccgacaacaccttcgtgagcggcaactgcgacgtcgtgatcgggatcgtgaacaacacggtctacgaccccctgcagccggagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagccggtgctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24862 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24863 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_D614G_I692V)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcccacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24864 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24865 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacccgcccgaggccgaggtgcagatcgaccggctgatcaccggccgcctccagtccctgcagacctacgtgacccagcagctgatccgggccgcggagatccgcgccagcgccaacctcgccgccaccaagatgagcgagtgcgtcctgggccagtccaagcgggtggacttctgcgggaagggctaccacctgatgagcttcccccagtccgcgccccacggggtggtcttcctccacgtgacgtacgtccccgcccaggagaagaacttcaccaccgccccggccatctgccacgacggcaaggcgcacttcccccgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagccggagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24866 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4064: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24867 - RNA, 4061 nt, synthetic construct
  misc_feature 1..4061: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacccgcccgaggccgaggtgcagatcgaccggctgatcacgggccgcctccagtccctgcagacctacgtcacccagcagctgatccgggcggccgagatccgcgccagcgccaacctcgccgcgaccaagatgagcgagtgcgtgctgggccagtccaagcgggtggacttctgcgggaagggctaccacctgatgagcttcccccagtccgcgccccacggggtcgtgttcctccacgtgacctacgtccccgcccaggagaagaacttcacgaccgcccccgccatctgccacgacggcaaggcccacttcccgcgcgagggggtgttcgtcagcaacggcacccactggttcgtgacccagcggaacttctacgagccccagatcatcacgacccacaacaccttcgtgtccggcaactgcgacgtcgtgatcgggatcgtgaacaacaccgtctacgaccccctgcagcccgagctggacagcttcaaggaggagctcgacaagtacttcaagaaccacacgtccccggacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24868 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24869 - RNA, 4061 nt, synthetic construct
  misc_feature 1..4061: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacccgcccgaggccgaggtgcagatcgaccgcctgatcaccggccggctccagagcctgcagacctacgtgacccagcagctgatccgcgccgcggagatccgggccagcgccaacctcgccgccaccaagatgtccgagtgcgtcctggggcagagcaagcgcgtggacttctgcggcaaggggtaccacctgatgtccttcccccagagcgcgccccacggcgtggtcttcctccacgtgacgtacgtccccgcccaggagaagaacttcaccaccgccccggccatctgccacgacgggaaggcgcacttcccccgggagggcgtgttcgtgtccaacggcacccactggttcgtcacgcagcgcaacttctacgagccccagatcatcaccaccgacaacaccttcgtgagcgggaactgcgacgtggtcatcggcatcgtgaacaacacggtgtacgaccccctgcagccggagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcggcaagtacgagcagtacatcaagtggccctggtacatctggctggggttcatcgccggcctgatcgccatcgtgatggtgaccatcatgctctgctgcatgaccagctgctgctcctgcctgaaggggtgctgcagctgcggctcctgctgcaagttcgacgaggacgacagcgagccggtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24870 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_E484K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24871 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgatcaagatgtccgagtgcgtgctcggccagagcaagcgcgtcgacttctgcgggaagggctaccacctgatgtccttcccccagagcgcgccccacggggtggtgttcctgcacgtcacctacgtgcccgcccaggagaagaacttcacgaccgcccccgccatctgccacgacggcaaggcccacttcccgcgggagggggtcttcgtgtccaacggcacccactggttcgtgacccagcgcaacttctacgagccccagatcatcacgaccgacaacaccttcgtcagcggcaactgcgacgtggtgatcgggatcgtcaacaacaccgtgtacgaccccctccagcccgagctggactccttcaaggaggagctggacaagtacttcaagaaccacacgagcccggacgtggacctcggcgacatctccgggatcaacgccagcgtcgtgaacatccagaaggagatcgaccggctgaacgaggtggccaagaacctgaacgagtccctcatcgacctgcaggagctgggcaagtacgagcagtacatcaagtggccctggtacatctggctcggcttcatcgccgggctgatcgcgatcgtcatggtgaccatcatgctgtgctgcatgaccagctgctgctcctgcctcaagggctgctgcagctgcgggtcctgctgcaagttcgacgaggacgacagcgagcccgtgctgaagggcgtcaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24872 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgaccaagatgagcgagtgcgtgctcggccagtccaagcgcgtcgacttctgcgggaagggctaccacctgatgagcttcccccagtccgcgccccacggggtggtgttcctgcacgtcacgtacgtgcccgcccaggagaagaacttcaccaccgccccggccatctgccacgacggcaaggcccacttcccccgggagggggtcttcgtgagcaacggcacccactggttcgtgacgcagcgcaacttctacgagccccagatcatcaccaccgacaacaccttcgtctccggcaactgcgacgtggtgatcgggatcgtcaacaacacggtgtacgaccccctccagccggagctggacagcttcaaggaggagctggacaagtacttcaagaaccacacctcccccgacgtggacctcggcgacatcagcgggatcaacgcctccgtcgtgaacatccagaaggagatcgaccggctgaacgaggtggccaagaacctgaacgagagcctcatcgacctgcaggagctgggcaagtacgagcagtacatcaagtggccctggtacatctggctcggcttcatcgccgggctgatcgcgatcgtcatggtgaccatcatgctgtgctgcatgacctcctgctgcagctgcctcaagggctgctgctcctgcgggagctgctgcaagttcgacgaggacgactccgagccggtgctgaagggcgtcaagctgcactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24873 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24874 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_ D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24875 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_A222V_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24876 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_N439K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24877 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_S477N_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24878 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24879 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24880 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24881 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_D614G_I692V)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24882 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24883 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24884 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24885 - RNA, 4061 nt, synthetic construct
  misc_feature 1..4061: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24886 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24887 - RNA, 4061 nt, synthetic construct
  misc_feature 1..4061: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24888 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_E484K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24889 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24890 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24891 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggcgtgttcgtgagcaacggaacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24892 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_ D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24893 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_A222V_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24894 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_N439K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24895 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_S477N_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24896 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24897 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtgcccgcccaggagaagaacttcaccaccgcccccgccatttgccacgacggcaaggcccacttcccccgggagggagtcttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24898 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24899 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_D614G_I692V)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24900 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24901 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24902 - RNA, 4064 nt, synthetic construct
  misc_feature 1..4064: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24903 - RNA, 4061 nt, synthetic construct
  misc_feature 1..4061: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacccacccgaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtgcccgcccaggagaagaacttcacaaccgcccccgccatctgccacgacggcaaggcccacttcccccgggagggagtcttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccctctgcagcccgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24904 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24905 - RNA, 4061 nt, synthetic construct
  misc_feature 1..4061: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggatcccccagaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgctccccacggcgtggtgttcctgcacgtcacatacgtgcccgcccaggagaagaacttcaccaccgcccccgccatctgccacgacggaaaggcccacttcccccgggagggcgtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctcgacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24906 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_E484K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24907 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacccacccgaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtgacctacgtccccgcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccctctccagcccgagctggacagcttcaaggaggagctggacaagtacttcaagaaccacaccagccccgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24908 - RNA, 4070 nt, synthetic construct
  misc_feature 1..4070: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggatcccccagaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgctccccacggcgtggtgttcctgcacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24909 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24910 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_ D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24911 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_A222V_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24912 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_N439K_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24913 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_S477N_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24914 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24915 - RNA, 4064 nt, synthetic construct
  misc_feature 1..4064: note = SARS-CoV-2/Wuhan/WIV05/2019__EPI_ISL_402128 spike protein mRNA gc mod (1-1273)(K986P_V987P_H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24916 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24917 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_D614G_I692V)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24918 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24919 - RNA, 4064 nt, synthetic construct
  misc_feature 1..4064: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4064: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24920 - RNA, 4064 nt, synthetic construct
  misc_feature 1..4064: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4064: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24921 - RNA, 4061 nt, synthetic construct
  misc_feature 1..4061: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24922 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24923 - RNA, 4061 nt, synthetic construct
  misc_feature 1..4061: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24924 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_K986P_V987P_E484K_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24925 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24926 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24927 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24928 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_ D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24929 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_A222V_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24930 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_N439K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24931 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_S477N_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24932 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24933 - RNA, 4064 nt, synthetic construct
  misc_feature 1..4064: note = SARS-CoV-2/Wuhan/WIV05/2019__EPI_ISL_402128 spike protein mRNA gc mod (1-1273)(K986P_V987P_H69del_V70del_D614G)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24934 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_Y453F_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24935 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_D614G_I692V)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24936 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_D614G_M1229I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24937 - RNA, 4064 nt, synthetic construct
  misc_feature 1..4064: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24938 - RNA, 4064 nt, synthetic construct
  misc_feature 1..4064: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4064: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24939 - RNA, 4061 nt, synthetic construct
  misc_feature 1..4061: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24940 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24941 - RNA, 4061 nt, synthetic construct
  misc_feature 1..4061: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4061: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24942 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_K986P_V987P_E484K_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24943 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24944 - RNA, 4070 nt, synthetic construct
  misc_feature 1..4070: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4070: mol_type = other RNA
aggagagtcccgcagtcggcgtccagcggctctgcttgttcgtgtgtgtgtcgttgcaggccttattcaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24945 - RNA, 1497 nt, synthetic construct
  misc_feature 1..1497: note = SARS-CoV-2/Wuhan/WIV05/2019__EPI_ISL_402128 spike protein mRNA gc (1-15,334-528) Ferritin construct
  source 1..1497: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24946 - RNA, 1095 nt, synthetic construct
  misc_feature 1..1095: note = SARS-CoV-2/Wuhan/WIV05/2019__EPI_ISL_402128 spike protein mRNA gc (334-528) Foldon construct
  source 1..1095: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24947 - RNA, 1473 nt, synthetic construct
  misc_feature 1..1473: note = SARS-CoV-2/Wuhan/WIV05/2019__EPI_ISL_402128 spike protein mRNA gc (1-15,334-528) LumSynth construct
  source 1..1473: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24948 - RNA, 1434 nt, synthetic construct
  misc_feature 1..1434: note = SARS-CoV-2/Wuhan/WIV05/2019__EPI_ISL_402128 spike protein mRNA gc (334-528) LumSynth construct
  source 1..1434: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24949 - RNA, 4167 nt, synthetic construct
  misc_feature 1..4167: note = SARS-CoV-2/Wuhan/WIV05/2019__EPI_ISL_402128 spike protein mRNA gc (1-1273)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24950 - RNA, 4167 nt, synthetic construct
  misc_feature 1..4167: note = SARS-CoV-2/Wuhan/WIV05/2019__EPI_ISL_402128 spike protein mRNA gc (1-1273)(D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24951 - RNA, 4167 nt, synthetic construct
  misc_feature 1..4167: note = SARS-CoV-2/Wuhan/WIV05/2019__EPI_ISL_402128 spike protein mRNA gc (1-1273)(A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24952 - RNA, 4167 nt, synthetic construct
  misc_feature 1..4167: note = SARS-CoV-2/Wuhan/WIV05/2019__EPI_ISL_402128 spike protein mRNA gc (1-1273)(N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24953 - RNA, 4167 nt, synthetic construct
  misc_feature 1..4167: note = SARS-CoV-2/Wuhan/WIV05/2019__EPI_ISL_402128 spike protein mRNA gc (1-1273)(S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24954 - RNA, 4167 nt, synthetic construct
  misc_feature 1..4167: note = SARS-CoV-2/Wuhan/WIV05/2019__EPI_ISL_402128 spike protein mRNA gc (1-1273)(N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24955 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24956 - RNA, 4167 nt, synthetic construct
  misc_feature 1..4167: note = SARS-CoV-2/Wuhan/WIV05/2019__EPI_ISL_402128 spike protein mRNA gc (1-1273)(Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24957 - RNA, 4167 nt, synthetic construct
  misc_feature 1..4167: note = SARS-CoV-2/Wuhan/WIV05/2019__EPI_ISL_402128 spike protein mRNA gc (1-1273)(D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24958 - RNA, 4167 nt, synthetic construct
  misc_feature 1..4167: note = SARS-CoV-2/Wuhan/WIV05/2019__EPI_ISL_402128 spike protein mRNA gc (1-1273)(D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24959 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24960 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_Y453F_D614G_I692V_M1229I)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24961 - RNA, 4158 nt, synthetic construct
  misc_feature 1..4158: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24962 - RNA, 4167 nt, synthetic construct
  misc_feature 1..4167: note = SARS-CoV-2/Wuhan/WIV05/2019__EPI_ISL_402128 spike protein mRNA gc (1-1273)(K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24963 - RNA, 4158 nt, synthetic construct
  misc_feature 1..4158: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24964 - RNA, 4167 nt, synthetic construct
  misc_feature 1..4167: note = SARS-CoV-2/Wuhan/WIV05/2019__EPI_ISL_402128 spike protein mRNA gc (1-1273)(E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24965 - RNA, 4167 nt, synthetic construct
  misc_feature 1..4167: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24966 - RNA, 4167 nt, synthetic construct
  misc_feature 1..4167: note = SARS-CoV-2/Wuhan/WIV05/2019__EPI_ISL_402128 spike protein mRNA gc (1-1273)(S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24967 - RNA, 4167 nt, synthetic construct; identical to SEQ ID NO: 24949
  misc_feature 1..4167: note = SARS-CoV-2/Wuhan/WIV05/2019__EPI_ISL_402128 spike protein mRNA gc (1-1273)
  source 1..4167: mol_type = other RNA

SEQ ID NO: 24968 - RNA, 4167 nt, synthetic construct
  misc_feature 1..4167: note = SARS-CoV-2/Wuhan/WIV05/2019__EPI_ISL_402128 spike protein mRNA gc (1-1273)(D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24969 - RNA, 4167 nt, synthetic construct
  misc_feature 1..4167: note = SARS-CoV-2/Wuhan/WIV05/2019__EPI_ISL_402128 spike protein mRNA gc (1-1273)(A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24970 - RNA, 4167 nt, synthetic construct
  misc_feature 1..4167: note = SARS-CoV-2/Wuhan/WIV05/2019__EPI_ISL_402128 spike protein mRNA gc (1-1273)(N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24971 - RNA, 4167 nt, synthetic construct
  misc_feature 1..4167: note = SARS-CoV-2/Wuhan/WIV05/2019__EPI_ISL_402128 spike protein mRNA gc (1-1273)(S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24972 - RNA, 4167 nt, synthetic construct
  misc_feature 1..4167: note = SARS-CoV-2/Wuhan/WIV05/2019__EPI_ISL_402128 spike protein mRNA gc (1-1273)(N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24973 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24974 - RNA, 4167 nt, synthetic construct
  misc_feature 1..4167: note = SARS-CoV-2/Wuhan/WIV05/2019__EPI_ISL_402128 spike protein mRNA gc (1-1273)(Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24975 - RNA, 4167 nt, synthetic construct
  misc_feature 1..4167: note = SARS-CoV-2/Wuhan/WIV05/2019__EPI_ISL_402128 spike protein mRNA gc (1-1273)(D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24976 - RNA, 4167 nt, synthetic construct
  misc_feature 1..4167: note = SARS-CoV-2/Wuhan/WIV05/2019__EPI_ISL_402128 spike protein mRNA gc (1-1273)(D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24977 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24978 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_Y453F_D614G_I692V_M1229I)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24979 - RNA, 4158 nt, synthetic construct
  misc_feature 1..4158: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24980 - RNA, 4167 nt, synthetic construct
  misc_feature 1..4167: note = SARS-CoV-2/Wuhan/WIV05/2019__EPI_ISL_402128 spike protein mRNA gc (1-1273)(K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24981 - RNA, 4158 nt, synthetic construct
  misc_feature 1..4158: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24982 - RNA, 4167 nt, synthetic construct
  misc_feature 1..4167: note = SARS-CoV-2/Wuhan/WIV05/2019__EPI_ISL_402128 spike protein mRNA gc (1-1273)(E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24983 - RNA, 4167 nt, synthetic construct
  misc_feature 1..4167: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24984 - RNA, 4167 nt, synthetic construct
  misc_feature 1..4167: note = SARS-CoV-2/Wuhan/WIV05/2019__EPI_ISL_402128 spike protein mRNA gc (1-1273)(S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24985 - RNA, 4167 nt, synthetic construct
  misc_feature 1..4167: note = SARS-CoV-2/Wuhan/WIV05/2019__EPI_ISL_402128 spike protein mRNA gc (1-1273)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24986 - RNA, 4167 nt, synthetic construct
  misc_feature 1..4167: note = SARS-CoV-2/Wuhan/WIV05/2019__EPI_ISL_402128 spike protein mRNA gc (1-1273)(D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24987 - RNA, 4167 nt, synthetic construct
  misc_feature 1..4167: note = SARS-CoV-2/Wuhan/WIV05/2019__EPI_ISL_402128 spike protein mRNA gc (1-1273)(A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24988 - RNA, 4167 nt, synthetic construct
  misc_feature 1..4167: note = SARS-CoV-2/Wuhan/WIV05/2019__EPI_ISL_402128 spike protein mRNA gc (1-1273)(N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24989 - RNA, 4167 nt, synthetic construct
  misc_feature 1..4167: note = SARS-CoV-2/Wuhan/WIV05/2019__EPI_ISL_402128 spike protein mRNA gc (1-1273)(S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24990 - RNA, 4167 nt, synthetic construct
  misc_feature 1..4167: note = SARS-CoV-2/Wuhan/WIV05/2019__EPI_ISL_402128 spike protein mRNA gc (1-1273)(N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24991 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24992 - RNA, 4167 nt, synthetic construct
  misc_feature 1..4167: note = SARS-CoV-2/Wuhan/WIV05/2019__EPI_ISL_402128 spike protein mRNA gc (1-1273)(Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24993 - RNA, 4167 nt, synthetic construct
  misc_feature 1..4167: note = SARS-CoV-2/Wuhan/WIV05/2019__EPI_ISL_402128 spike protein mRNA gc (1-1273)(D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24994 - RNA, 4167 nt, synthetic construct
  misc_feature 1..4167: note = SARS-CoV-2/Wuhan/WIV05/2019__EPI_ISL_402128 spike protein mRNA gc (1-1273)(D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24995 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24996 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_Y453F_D614G_I692V_M1229I)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24997 - RNA, 4158 nt, synthetic construct
  misc_feature 1..4158: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24998 - RNA, 4167 nt, synthetic construct
  misc_feature 1..4167: note = SARS-CoV-2/Wuhan/WIV05/2019__EPI_ISL_402128 spike protein mRNA gc (1-1273)(K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24999 - RNA, 4158 nt, synthetic construct
  misc_feature 1..4158: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25000 - RNA, 4167 nt, synthetic construct
  misc_feature 1..4167: note = SARS-CoV-2/Wuhan/WIV05/2019__EPI_ISL_402128 spike protein mRNA gc (1-1273)(E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25001 - RNA, 4167 nt, synthetic construct
  misc_feature 1..4167: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25002 - RNA, 4167 nt, synthetic construct
  misc_feature 1..4167: note = SARS-CoV-2/Wuhan/WIV05/2019__EPI_ISL_402128 spike protein mRNA gc (1-1273)(S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25003 - RNA, 4167 nt, synthetic construct
  misc_feature 1..4167: note = SARS-CoV-2/Wuhan/WIV05/2019__EPI_ISL_402128 spike protein mRNA gc (1-1273)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggcgtgttcgtgagcaacggaacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgatgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25004 - RNA, 4167 nt, synthetic construct
  misc_feature 1..4167: note = SARS-CoV-2/Wuhan/WIV05/2019__EPI_ISL_402128 spike protein mRNA gc (1-1273)(D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25005 - RNA, 4167 nt, synthetic construct
  misc_feature 1..4167: note = SARS-CoV-2/Wuhan/WIV05/2019__EPI_ISL_402128 spike protein mRNA gc (1-1273)(A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatttgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25006 - RNA, 4167 nt, synthetic construct
  misc_feature 1..4167: note = SARS-CoV-2/Wuhan/WIV05/2019__EPI_ISL_402128 spike protein mRNA gc (1-1273)(N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25007 - RNA, 4167 nt, synthetic construct
  misc_feature 1..4167: note = SARS-CoV-2/Wuhan/WIV05/2019__EPI_ISL_402128 spike protein mRNA gc (1-1273)(S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25008 - RNA, 4167 nt, synthetic construct
  misc_feature 1..4167: note = SARS-CoV-2/Wuhan/WIV05/2019__EPI_ISL_402128 spike protein mRNA gc (1-1273)(N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25009 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtgacatacgtccccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25010 - RNA, 4167 nt, synthetic construct
  misc_feature 1..4167: note = SARS-CoV-2/Wuhan/WIV05/2019__EPI_ISL_402128 spike protein mRNA gc (1-1273)(Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25011 - RNA, 4167 nt, synthetic construct
  misc_feature 1..4167: note = SARS-CoV-2/Wuhan/WIV05/2019__EPI_ISL_402128 spike protein mRNA gc (1-1273)(D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25012 - RNA, 4167 nt, synthetic construct
  misc_feature 1..4167: note = SARS-CoV-2/Wuhan/WIV05/2019__EPI_ISL_402128 spike protein mRNA gc (1-1273)(D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25013 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgccccacacggcgtggtcttcctccacgtgacatacgtgcccgcccaggagaagaacttcaccaccgcccccgccatctgccacgacggcaaggcccacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25014 - RNA, 4161 nt, synthetic construct
  misc_feature 1..4161: note = SARS-CoV-2/Wuhan/WIV05/2019__EPI_ISL_402128 spike protein mRNA gc (1-1273)(H69del_V70del_Y453F_D614G_I692V_M1229I)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25015 - RNA, 4158 nt, synthetic construct
  misc_feature 1..4158: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacaaggtggaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtcccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccccctgcagcccgagctggacagcttcaaggaggagctggacaagtacttcaagaaccacaccagccctgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25016 - RNA, 4167 nt, synthetic construct
  misc_feature 1..4167: note = SARS-CoV-2/Wuhan/WIV05/2019__EPI_ISL_402128 spike protein mRNA gc (1-1273)(K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25017 - RNA, 4158 nt, synthetic construct
  misc_feature 1..4158: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggacaaggtggaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgccccacacggcgtggtcttcctgcacgtgacatacgtgcccgcccaggagaagaacttcaccaccgcccccgccatctgccacgacggaaaggcccacttcccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctcgacaagtacttcaagaaccacaccagccccgacgtggacctgggcgacatcagcggcatcaacgctagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25018 - RNA, 4167 nt, synthetic construct
  misc_feature 1..4167: note = SARS-CoV-2/Wuhan/WIV05/2019__EPI_ISL_402128 spike protein mRNA gc (1-1273)(E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25019 - RNA, 4167 nt, synthetic construct
  misc_feature 1..4167: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacaaggtggaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtcacctacgtgccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagccctgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25020 - RNA, 4167 nt, synthetic construct
  misc_feature 1..4167: note = SARS-CoV-2/Wuhan/WIV05/2019__EPI_ISL_402128 spike protein mRNA gc (1-1273)(S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggacaaggtggaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgccccacacggcgtggtgttcctgcacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagccagtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25021 - RNA, 4167 nt, synthetic construct
  misc_feature 1..4167: note = SARS-CoV-2/Wuhan/WIV05/2019__EPI_ISL_402128 spike protein mRNA gc mod (1-1273)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25022 - RNA, 4167 nt, synthetic construct
  misc_feature 1..4167: note = SARS-CoV-2/Wuhan/WIV05/2019__EPI_ISL_402128 spike protein mRNA gc mod (1-1273)(D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25023 - RNA, 4167 nt, synthetic construct
  misc_feature 1..4167: note = SARS-CoV-2/Wuhan/WIV05/2019__EPI_ISL_402128 spike protein mRNA gc mod (1-1273)(A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25024 - RNA, 4167 nt, synthetic construct
  misc_feature 1..4167: note = SARS-CoV-2/Wuhan/WIV05/2019__EPI_ISL_402128 spike protein mRNA gc mod (1-1273)(N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25025 - RNA, 4167 nt, synthetic construct
  misc_feature 1..4167: note = SARS-CoV-2/Wuhan/WIV05/2019__EPI_ISL_402128 spike protein mRNA gc mod (1-1273)(S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25026 - RNA, 4167 nt, synthetic construct
  misc_feature 1..4167: note = SARS-CoV-2/Wuhan/WIV05/2019__EPI_ISL_402128 spike protein mRNA gc mod (1-1273)(N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25027 - RNA, 4161 nt, synthetic construct
  misc_feature 1..4161: note = SARS-CoV-2/Wuhan/WIV05/2019__EPI_ISL_402128 spike protein mRNA gc mod (1-1273)(H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25028 - RNA, 4167 nt, synthetic construct
  misc_feature 1..4167: note = SARS-CoV-2/Wuhan/WIV05/2019__EPI_ISL_402128 spike protein mRNA gc mod (1-1273)(Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25029 - RNA, 4167 nt, synthetic construct
  misc_feature 1..4167: note = SARS-CoV-2/Wuhan/WIV05/2019__EPI_ISL_402128 spike protein mRNA gc mod (1-1273)(D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25030 - RNA, 4167 nt, synthetic construct
  misc_feature 1..4167: note = SARS-CoV-2/Wuhan/WIV05/2019__EPI_ISL_402128 spike protein mRNA gc mod (1-1273)(D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25031 - RNA, 4161 nt, synthetic construct
  misc_feature 1..4161: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25032 - RNA, 4161 nt, synthetic construct
  misc_feature 1..4161: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25033 - RNA, 4158 nt, synthetic construct
  misc_feature 1..4158: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25034 - RNA, 4167 nt, synthetic construct
  misc_feature 1..4167: note = SARS-CoV-2/Wuhan/WIV05/2019__EPI_ISL_402128 spike protein mRNA gc mod (1-1273)(K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25035 - RNA, 4158 nt, synthetic construct
  misc_feature 1..4158: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25036 - RNA, 4167 nt, synthetic construct
  misc_feature 1..4167: note = SARS-CoV-2/Wuhan/WIV05/2019__EPI_ISL_402128 spike protein mRNA gc mod (1-1273)(E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25037 - RNA, 4167 nt, synthetic construct
  misc_feature 1..4167: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25038 - RNA, 4167 nt, synthetic construct
  misc_feature 1..4167: note = SARS-CoV-2/Wuhan/WIV05/2019__EPI_ISL_402128 spike protein mRNA gc mod (1-1273)(S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25039 - RNA, 4167 nt, synthetic construct
  misc_feature 1..4167: note = SARS-CoV-2/Wuhan/WIV05/2019__EPI_ISL_402128 spike protein mRNA gc mod (1-1273)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25040 - RNA, 4167 nt, synthetic construct
  misc_feature 1..4167: note = SARS-CoV-2/Wuhan/WIV05/2019__EPI_ISL_402128 spike protein mRNA gc mod (1-1273)(D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25041 - RNA, 4167 nt, synthetic construct
  misc_feature 1..4167: note = SARS-CoV-2/Wuhan/WIV05/2019__EPI_ISL_402128 spike protein mRNA gc mod (1-1273)(A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25042 - RNA, 4167 nt, synthetic construct
  misc_feature 1..4167: note = SARS-CoV-2/Wuhan/WIV05/2019__EPI_ISL_402128 spike protein mRNA gc mod (1-1273)(N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25043 - RNA, 4167 nt, synthetic construct
  misc_feature 1..4167: note = SARS-CoV-2/Wuhan/WIV05/2019__EPI_ISL_402128 spike protein mRNA gc mod (1-1273)(S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25044 - RNA, 4167 nt, synthetic construct
  misc_feature 1..4167: note = SARS-CoV-2/Wuhan/WIV05/2019__EPI_ISL_402128 spike protein mRNA gc mod (1-1273)(N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25045 - RNA, 4161 nt, synthetic construct
  misc_feature 1..4161: note = SARS-CoV-2/Wuhan/WIV05/2019__EPI_ISL_402128 spike protein mRNA gc mod (1-1273)(H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25046 - RNA, 4167 nt, synthetic construct
  misc_feature 1..4167: note = SARS-CoV-2/Wuhan/WIV05/2019__EPI_ISL_402128 spike protein mRNA gc mod (1-1273)(Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25047 - RNA, 4167 nt, synthetic construct
  misc_feature 1..4167: note = SARS-CoV-2/Wuhan/WIV05/2019__EPI_ISL_402128 spike protein mRNA gc mod (1-1273)(D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25048 - RNA, 4167 nt, synthetic construct
  misc_feature 1..4167: note = SARS-CoV-2/Wuhan/WIV05/2019__EPI_ISL_402128 spike protein mRNA gc mod (1-1273)(D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25049 - RNA, 4161 nt, synthetic construct
  misc_feature 1..4161: note = SARS-CoV-2/Wuhan/WIV05/2019__EPI_ISL_402128 spike protein mRNA gc mod (1-1273)(H69del_V70del_A222V_Y453F_S477N_D614G_I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25050 - RNA, 4161 nt, synthetic construct
  misc_feature 1..4161: note = SARS-CoV-2/Wuhan/WIV05/2019__EPI_ISL_402128 spike protein mRNA gc mod (1-1273)(H69del_V70del_Y453F_D614G_I692V_M1229I)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25051 - RNA, 4158 nt, synthetic construct
  misc_feature 1..4158: note = SARS-CoV-2/Wuhan/WIV05/2019__EPI_ISL_402128 spike protein mRNA gc mod (1-1273)(H69del_V70del_Y144del_N501Y_A570D_D614G_P681H_T716 I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25052 - RNA, 4167 nt, synthetic construct
  misc_feature 1..4167: note = SARS-CoV-2/Wuhan/WIV05/2019__EPI_ISL_402128 spike protein mRNA gc mod (1-1273)(K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25053 - RNA, 4158 nt, synthetic construct
  misc_feature 1..4158: note = SARS-CoV-2/Wuhan/WIV05/2019__EPI_ISL_402128 spike protein mRNA gc mod (1-1273)(L18F_D80A_D215G_L242del_A243del_L244del_R246I_K417 N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25054 - RNA, 4167 nt, synthetic construct
  misc_feature 1..4167: note = SARS-CoV-2/Wuhan/WIV05/2019__EPI_ISL_402128 spike protein mRNA gc mod (1-1273)(E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25055 - RNA, 4167 nt, synthetic construct
  misc_feature 1..4167: note = SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G _H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25056 - RNA, 4167 nt, synthetic construct
  misc_feature 1..4167: note = SARS-CoV-2/Wuhan/WIV05/2019__EPI_ISL_402128 spike protein mRNA gc mod (1-1273)(S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25057 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P) R10184
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25058 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_ D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25059 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25060 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25061 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25062 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25063 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25064 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25065 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25066 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25067 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25068 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25069 - RNA, 4158 nt, synthetic construct
  misc_feature 1..4158: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25070 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25071 - RNA, 4158 nt, synthetic construct
  misc_feature 1..4158: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25072 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25073 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25074 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25075 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtccagatcgaccggctgatcaccgggcgcctccagagcctgcagacctacgtgacccagcagctgatccgggcggccgagatccgcgccagcgccaacctcgccgcgaccaagatgtccgagtgcgtgctgggccagagcaagcgggtcgacttctgcggcaaggggtaccacctgatgtccttcccccagagcgcgccccacggcgtggtgttcctccacgtcacgtacgtgcccgcccaggagaagaacttcaccaccgccccggccatctgccacgacgggaaggcccacttcccccgcgagggcgtcttcgtgtccaacgggacccactggttcgtgacgcagcggaacttctacgagccccagatcatcaccaccgacaacaccttcgtcagcggcaactgcgacgtggtgatcggcatcgtcaacaacacggtgtacgaccccctgcagccggagctggactccttcaaggaggagctcgacaagtacttcaagaaccacaccagccccgacgtggacctgggggacatctccggcatcaacgccagcgtcgtgaacatccagaaggagatcgaccgcctgaacgaggtggccaagaacctcaacgagtccctgatcgacctgcaggagctcgggaagtacgagcagtacatcaagtggccctggtacatctggctgggcttcatcgccggcctgatcgcgatcgtcatggtgaccatcatgctctgctgcatgaccagctgctgctcctgcctgaaggggtgctgcagctgcggctcctgctgcaagttcgacgaggacgacagcgagccggtgctgaagggggtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25076 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_ D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25077 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggccgcggagatccgcgccagcgccaacctcgccgccaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcgcacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgccatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25078 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25079 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacccgcccgaggccgaggtccagatcgaccggctgatcaccggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacgtacgtgcccgcccaggagaagaacttcaccaccgccccggccatctgccacgacggcaaggcccacttcccccgcgagggggtcttcgtgagcaacggcacccactggttcgtgacgcagcggaacttctacgagccccagatcatcaccaccgacaacaccttcgtctccggcaactgcgacgtggtgatcgggatcgtcaacaacacggtgtacgaccccctgcagccggagctggacagcttcaaggaggagctcgacaagtacttcaagaaccacacctcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25080 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25081 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacccgcccgaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgcgccccacggggtcgtgttcctccacgtgacgtacgtccccgcccaggagaagaacttcaccaccgccccggccatctgccacgacggcaaggcccacttcccccgcgagggggtgttcgtctccaacggcacccactggttcgtgacgcagcggaacttctacgagccccagatcatcaccaccgacaacaccttcgtgagcggcaactgcgacgtcgtgatcgggatcgtgaacaacacggtctacgaccccctgcagccggagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagccggtgctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25082 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25083 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacccgcccgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgcgccccacggggtggtcttcctccacgtgacgtacgtccccgcccaggagaagaacttcaccaccgccccggccatctgccacgacggcaaggcccacttcccccgcgagggggtgttcgtgtccaacggcacccactggttcgtcacgcagcggaacttctacgagccccagatcatcaccaccgacaacaccttcgtgagcggcaactgcgacgtggtcatcgggatcgtgaacaacacggtgtacgaccccctgcagccggagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccctggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagccggtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25084 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25085 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacccgcccgaggccgaggtgcagatcgaccggctgatcaccggccgcctccagtccctgcagacctacgtgacccagcagctgatccgggccgcggagatccgcgccagcgccaacctcgccgccaccaagatgagcgagtgcgtcctgggccagtccaagcgggtggacttctgcgggaagggctaccacctgatgagcttcccccagtccgcgccccacggggtggtcttcctccacgtgacgtacgtccccgcccaggagaagaacttcaccaccgccccggccatctgccacgacggcaaggcgcacttcccccgcgagggggtgttcgtgagcaacggcacccactggttcgtcacgcagcggaacttctacgagccccagatcatcaccaccgacaacaccttcgtgtccggcaactgcgacgtggtcatcgggatcgtgaacaacacggtgtacgaccccctgcagccggagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccctggtacatctggctgggcttcatcgccgggctgatcgccatcgtgatggtgaccatcatgctctgctgcatgacctcctgctgcagctgcctgaagggctgctgctcctgcgggagctgctgcaagttcgacgaggacgactccgagccggtcctgaagggcgtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25086 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatcgtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25087 - RNA, 4158 nt, synthetic construct
  misc_feature 1..4158: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacccgcccgaggccgaggtgcagatcgaccggctgatcacgggccgcctccagtccctgcagacctacgtcacccagcagctgatccgggcggccgagatccgcgccagcgccaacctcgccgcgaccaagatgagcgagtgcgtgctgggccagtccaagcgggtggacttctgcgggaagggctaccacctgatgagcttcccccagtccgcgccccacggggtcgtgttcctccacgtgacctacgtccccgcccaggagaagaacttcacgaccgcccccgccatctgccacgacggcaaggcccacttcccgcgcgagggggtgttcgtcagcaacggcacccactggttcgtgacccagcggaacttctacgagccccagatcatcacgacccacaacaccttcgtgtccggcaactgcgacgtcgtgatcgggatcgtgaacaacaccgtctacgaccccctgcagcccgagctggacagcttcaaggaggagctcgacaagtacttcaagaaccacacgtccccggacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25088 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25089 - RNA, 4158 nt, synthetic construct
  misc_feature 1..4158: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacccgcccgaggccgaggtgcagatcgaccgcctgatcaccggccggctccagagcctgcagacctacgtgacccagcagctgatccgcgccgcggagatccgggccagcgccaacctcgccgccaccaagatgtccgagtgcgtcctggggcagagcaagcgcgtggacttctgcggcaaggggtaccacctgatgtccttcccccagagcgcgccccacggcgtggtcttcctccacgtgacgtacgtccccgcccaggagaagaacttcaccaccgccccggccatctgccacgacgggaaggcgcacttcccccgggagggcgtgttcgtgtccaacggcacccactggttcgtcacgcagcgcaacttctacgagccccagatcatcaccaccgacaacaccttcgtgagcgggaactgcgacgtggtcatcggcatcgtgaacaacacggtgtacgaccccctgcagccggagctggactccttcaaggaggagctcgacaagtacttcaagaaccacaccagccccgacgtcgacctgggggacatctccggcatcaacgccagcgtggtgaacatccagaaggagatcgaccggctgaacgaggtcgccaagaacctcaacgagtccctgatcgacctgcaggagctcggcaagtacgagcagtacatcaagtggccctggtacatctggctggggttcatcgccggcctgatcgccatcgtgatggtgaccatcatgctctgctgcatgaccagctgctgctcctgcctgaaggggtgctgcagctgcggctcctgctgcaagttcgacgaggacgacagcgagccggtcctgaagggggtgaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25090 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacccgcccgaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgcgccccacggggtggtgttcctccacgtcacgtacgtgcccgcccaggagaagaacttcaccaccgccccggccatctgccacgacggcaaggcccacttcccccgcgagggggtcttcgtgtccaacggcacccactggttcgtgacgcagcggaacttctacgagccccagatcatcaccaccgacaacaccttcgtcagcggcaactgcgacgtggtgatcgggatcgtcaacaacacggtgtacgaccccctgcagccggagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccctggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagccggtgctgaagggcgtcaagctccactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25091 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgatcaagatgtccgagtgcgtgctcggccagagcaagcgcgtcgacttctgcgggaagggctaccacctgatgtccttcccccagagcgcgccccacggggtggtgttcctgcacgtcacctacgtgcccgcccaggagaagaacttcacgaccgcccccgccatctgccacgacggcaaggcccacttcccgcgggagggggtcttcgtgtccaacggcacccactggttcgtgacccagcgcaacttctacgagccccagatcatcacgaccgacaacaccttcgtcagcggcaactgcgacgtggtgatcgggatcgtcaacaacaccgtgtacgaccccctccagcccgagctggactccttcaaggaggagctggacaagtacttcaagaaccacacgagcccggacgtggacctcggcgacatctccgggatcaacgccagcgtcgtgaacatccagaaggagatcgaccggctgaacgaggtggccaagaacctgaacgagtccctcatcgacctgcaggagctgggcaagtacgagcagtacatcaagtggccctggtacatctggctcggcttcatcgccgggctgatcgcgatcgtcatggtgaccatcatgctgtgctgcatgaccagctgctgctcctgcctcaagggctgctgcagctgcgggtcctgctgcaagttcgacgaggacgacagcgagcccgtgctgaagggcgtcaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25092 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacccgcccgaggccgaggtccagatcgaccgcctgatcaccggccggctgcagtccctccagacctacgtgacccagcagctgatccgcgcggccgagatccgggccagcgccaacctggccgcgaccaagatgagcgagtgcgtgctcggccagtccaagcgcgtcgacttctgcgggaagggctaccacctgatgagcttcccccagtccgcgccccacggggtggtgttcctgcacgtcacgtacgtgcccgcccaggagaagaacttcaccaccgccccggccatctgccacgacggcaaggcccacttcccccgggagggggtcttcgtgagcaacggcacccactggttcgtgacgcagcgcaacttctacgagccccagatcatcaccaccgacaacaccttcgtctccggcaactgcgacgtggtgatcgggatcgtcaacaacacggtgtacgaccccctccagccggagctggacagcttcaaggaggagctggacaagtacttcaagaaccacacctcccccgacgtggacctcggcgacatcagcgggatcaacgcctccgtcgtgaacatccagaaggagatcgaccggctgaacgaggtggccaagaacctgaacgagagcctcatcgacctgcaggagctgggcaagtacgagcagtacatcaagtggccctggtacatctggctcggcttcatcgccgggctgatcgcgatcgtcatggtgaccatcatgctgtgctgcatgacctcctgctgcagctgcctcaagggctgctgctcctgcgggagctgctgcaagttcgacgaggacgactccgagccggtgctgaagggcgtcaagctgcactacacgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25093 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25094 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_ D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25095 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25096 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25097 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25098 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25099 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25100 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25101 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25102 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25103 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25104 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25105 - RNA, 4158 nt, synthetic construct
  misc_feature 1..4158: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25106 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25107 - RNA, 4158 nt, synthetic construct
  misc_feature 1..4158: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25108 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25109 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25110 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25111 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggcgtgttcgtgagcaacggaacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25112 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_ D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25113 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25114 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25115 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25116 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggatcccccagaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25117 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtgcccgcccaggagaagaacttcaccaccgcccccgccatttgccacgacggcaaggcccacttcccccgggagggagtcttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25118 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25119 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25120 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25121 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggatcccccagaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgctccccacggcgtggtgttcctccacgtcacatacgtgcccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25122 - RNA, 4161 nt, synthetic construct
  misc_feature 1..4161: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgctccccacggcgtggtgttcctccacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagattatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25123 - RNA, 4158 nt, synthetic construct
  misc_feature 1..4158: note = SARS-CoV-2/Wuhan/WIV05/2019__EPI_ISL_402128 spike protein mRNA gc (1-1273)(K986P_V987P_K986P_V987P_H69del_V70del_Y144del_N501 Y_A570D_D614G_P681H_T716I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacccacccgaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtgcccgcccaggagaagaacttcacaaccgcccccgccatctgccacgacggcaaggcccacttcccccgggagggagtcttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccctctgcagcccgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25124 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25125 - RNA, 4158 nt, synthetic construct
  misc_feature 1..4158: note = SARS-CoV-2/Wuhan/WIV05/2019__EPI_ISL_402128 spike protein mRNA gc (1-1273)(K986P_V987P_K986P_V987P_L18F_D80A_D215G_L242del_A2 43del_L244del_R246I_K417N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggatcccccagaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgctccccacggcgtggtgttcctgcacgtcacatacgtgcccgcccaggagaagaacttcaccaccgcccccgccatctgccacgacggaaaggcccacttcccccgggagggcgtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctcgacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25126 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggatcccccagaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgctccccacggcgtggtgttcctccacgtgacatacgtccccgcccaggagaagaacttcaccaccgcccccgccatttgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctgcagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25127 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_L18F_T20N_P26S_D138Y_R190S _K417T_E484K_N501Y_D614G_H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacccacccgaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtgacctacgtccccgcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccctctccagcccgagctggacagcttcaaggaggagctggacaagtacttcaagaaccacaccagccccgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccatggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25128 - RNA, 4167 nt, synthetic construct
  misc_feature 1..4167: note = SARS-CoV-2/Wuhan/WIV05/2019__EPI_ISL_402128 spike protein mRNA gc (1-1273)(K986P_V987P_K986P_V987P_S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggatcccccagaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgctccccacggcgtggtgttcctgcacgtgacatacgtccccgcccaggagaagaacttcaccaccgcccccgccatctgccacgacggcaaggcccacttcccccgggagggagtgttcgtgagcaacggcacccactggttcgtgacccagcggaacttctacgagcctcagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagcccagacgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagcccgtgctgaagggcgtgaagctgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25129 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25130 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_ D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25131 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25132 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25133 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25134 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25135 - RNA, 4161 nt, synthetic construct
  misc_feature 1..4161: note = SARS-CoV-2/Wuhan/WIV05/2019__EPI_ISL_402128 spike protein mRNA gc mod (1-1273)(K986P_V987P_H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25136 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25137 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25138 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25139 - RNA, 4161 nt, synthetic construct
  misc_feature 1..4161: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25140 - RNA, 4161 nt, synthetic construct
  misc_feature 1..4161: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25141 - RNA, 4158 nt, synthetic construct
  misc_feature 1..4158: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25142 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25143 - RNA, 4158 nt, synthetic construct
  misc_feature 1..4158: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25144 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_K986P_V987P_E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25145 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25146 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25147 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25148 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_ D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25149 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_A222V_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25150 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_N439K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25151 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_S477N_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25152 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25153 - RNA, 4161 nt, synthetic construct
  misc_feature 1..4161: note = SARS-CoV-2/Wuhan/WIV05/2019__EPI_ISL_402128 spike protein mRNA gc mod (1-1273)(K986P_V987P_H69del_V70del_D614G)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25154 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_Y453F_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25155 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_D614G_I692V)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25156 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_D614G_M1229I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25157 - RNA, 4161 nt, synthetic construct
  misc_feature 1..4161: note = SARS-CoV-2/Wuhan/WIV05/2019__EPI_ISL_402128 spike protein mRNA gc mod (1-1273)(K986P_V987P_H69del_V70del_A222V_Y453F_S477N_D614G_ I692V)
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25158 - RNA, 4161 nt, synthetic construct
  misc_feature 1..4161: note = SARS-CoV-2/Wuhan/WIV05/2019__EPI_ISL_402128 spike protein mRNA gc mod (1-1273)(K986P_V987P_H69del_V70del_Y453F_D614G_I692V_M1229I )
  source 1..4161: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25159 - RNA, 4158 nt, synthetic construct
  misc_feature 1..4158: note = SARS-CoV-2/Wuhan/WIV05/2019__EPI_ISL_402128 spike protein mRNA gc mod (1-1273)(K986P_V987P_K986P_V987P_H69del_V70del_Y144del_N501 Y_A570D_D614G_P681H_T716I_S982A_D1118H)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25160 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_K986P_V987P_K417N_E484K_N501Y_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25161 - RNA, 4158 nt, synthetic construct
  misc_feature 1..4158: note = SARS-CoV-2/Wuhan/WIV05/2019__EPI_ISL_402128 spike protein mRNA gc mod (1-1273)(K986P_V987P_K986P_V987P_L18F_D80A_D215G_L242del_A2 43del_L244del_R246I_K417N_E484K_N501Y_D614G_A701V)
  source 1..4158: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacttcaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgtggagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25162 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_K986P_V987P_E484K_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25163 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S _K417T_E484K_N501Y_D614G_H655Y_T1027I)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccagccagtgtgtgaacttcaccaacagaacacagctgcctagcgcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtgaagggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25164 - RNA, 4167 nt, synthetic construct
  misc_feature 1..4167: note = SARS-CoV-2/Wuhan/WIV05/2019__EPI_ISL_402128 spike protein mRNA gc mod (1-1273)(K986P_V987P_K986P_V987P_S13I_W152C_L452R_D614G)
  source 1..4167: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgttcgtgttcctggtgctgctgcctctggtgtccatccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25165 - RNA, 1435 nt, synthetic construct
  misc_feature 1..1435: note = SARS-CoV-2/Wuhan/WIV05/2019__EPI_ISL_402128 spike protein mRNA gc (1-15,334-528) Ferritin construct
  source 1..1435: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25166 - RNA, 1033 nt, synthetic construct
  misc_feature 1..1033: note = SARS-CoV-2/Wuhan/WIV05/2019__EPI_ISL_402128 spike protein mRNA gc (334-528) Foldon construct
  source 1..1033: mol_type = other RNA
aggagacccgtgacccggaagttgtacggctacgcgactttccctcccacaaaccctcgcgcccttcctttcctacttgggcccggcagaaagcttaccatgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25167 - RNA, 1411 nt, synthetic construct
  misc_feature 1..1411: note = SARS-CoV-2/Wuhan/WIV05/2019__EPI_ISL_402128 spike protein mRNA gc (1-15,334-528) LumSynth construct
  source 1..1411: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25168 - RNA, 1372 nt, synthetic construct
  misc_feature 1..1372: note = SARS-CoV-2/Wuhan/WIV05/2019__EPI_ISL_402128 spike protein mRNA gc (334-528) LumSynth construct
  source 1..1372: mol_type = other RNA
aggagacccgtgacccggaagttgtacggctacgcgactttccctcccacaaaccctcgcgcccttcctttcctacttgggcccggcagaaagcttaccatgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25169 - RNA, 4105 nt, synthetic construct
  misc_feature 1..4105: note = SARS-CoV-2/Wuhan/WIV05/2019__EPI_ISL_402128 spike protein mRNA gc (1-1273)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25170 - RNA, 4105 nt, synthetic construct
  misc_feature 1..4105: note = SARS-CoV-2/Wuhan/WIV05/2019__EPI_ISL_402128 spike protein mRNA gc (1-1273)(D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25171 - RNA, 4105 nt, synthetic construct
  misc_feature 1..4105: note = SARS-CoV-2/Wuhan/WIV05/2019__EPI_ISL_402128 spike protein mRNA gc (1-1273)(A222V_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25172 - RNA, 4105 nt, synthetic construct
  misc_feature 1..4105: note = SARS-CoV-2/Wuhan/WIV05/2019__EPI_ISL_402128 spike protein mRNA gc (1-1273)(N439K_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25173 - RNA, 4105 nt, synthetic construct
  misc_feature 1..4105: note = SARS-CoV-2/Wuhan/WIV05/2019__EPI_ISL_402128 spike protein mRNA gc (1-1273)(S477N_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25174 - RNA, 4105 nt, synthetic construct
  misc_feature 1..4105: note = SARS-CoV-2/Wuhan/WIV05/2019__EPI_ISL_402128 spike protein mRNA gc (1-1273)(N501Y_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25175 - RNA, 4099 nt, synthetic construct
  misc_feature 1..4099: note = SARS-CoV-2/Wuhan/WIV05/2019__EPI_ISL_402128 spike protein mRNA gc (1-1273)(H69del_V70del_D614G)
  source 1..4099: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25176 - RNA, 4105 nt, synthetic construct
  misc_feature 1..4105: note = SARS-CoV-2/Wuhan/WIV05/2019__EPI_ISL_402128 spike protein mRNA gc (1-1273)(Y453F_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25177 - RNA, 4105 nt, synthetic construct
  misc_feature 1..4105: note = SARS-CoV-2/Wuhan/WIV05/2019__EPI_ISL_402128 spike protein mRNA gc (1-1273)(D614G_I692V)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25178 - RNA, 4105 nt, synthetic construct
  misc_feature 1..4105: note = SARS-CoV-2/Wuhan/WIV05/2019__EPI_ISL_402128 spike protein mRNA gc (1-1273)(D614G_M1229I)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25179 - RNA, 4099 nt, synthetic construct
  misc_feature 1..4099: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4099: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25180 - RNA, 4099 nt, synthetic construct
  misc_feature 1..4099: note = SARS-CoV-2/Wuhan/WIV05/2019__EPI_ISL_402128 spike protein mRNA gc (1-1273)(H69del_V70del_Y453F_D614G_I692V_M1229I)
  source 1..4099: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25181 - RNA, 4096 nt, synthetic construct
  misc_feature 1..4096: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4096: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25182 - RNA, 4105 nt, synthetic construct
  misc_feature 1..4105: note = SARS-CoV-2/Wuhan/WIV05/2019__EPI_ISL_402128 spike protein mRNA gc (1-1273)(K417N_E484K_N501Y_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25183 - RNA, 4096 nt, synthetic construct
  misc_feature 1..4096: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4096: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25184 - RNA, 4105 nt, synthetic construct
  misc_feature 1..4105: note = SARS-CoV-2/Wuhan/WIV05/2019__EPI_ISL_402128 spike protein mRNA gc (1-1273)(E484K_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25185 - RNA, 4105 nt, synthetic construct
  misc_feature 1..4105: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25186 - RNA, 4105 nt, synthetic construct
  misc_feature 1..4105: note = SARS-CoV-2/Wuhan/WIV05/2019__EPI_ISL_402128 spike protein mRNA gc (1-1273)(S13I_W152C_L452R_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25187 - RNA, 4105 nt, synthetic construct; identical to SEQ ID NO: 25169
  misc_feature 1..4105: note = SARS-CoV-2/Wuhan/WIV05/2019__EPI_ISL_402128 spike protein mRNA gc (1-1273)
  source 1..4105: mol_type = other RNA

SEQ ID NO: 25188 - RNA, 4105 nt, synthetic construct
  misc_feature 1..4105: note = SARS-CoV-2/Wuhan/WIV05/2019__EPI_ISL_402128 spike protein mRNA gc (1-1273)(D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25189 - RNA, 4105 nt, synthetic construct
  misc_feature 1..4105: note = SARS-CoV-2/Wuhan/WIV05/2019__EPI_ISL_402128 spike protein mRNA gc (1-1273)(A222V_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25190 - RNA, 4105 nt, synthetic construct
  misc_feature 1..4105: note = SARS-CoV-2/Wuhan/WIV05/2019__EPI_ISL_402128 spike protein mRNA gc (1-1273)(N439K_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25191 - RNA, 4105 nt, synthetic construct
  misc_feature 1..4105: note = SARS-CoV-2/Wuhan/WIV05/2019__EPI_ISL_402128 spike protein mRNA gc (1-1273)(S477N_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25192 - RNA, 4105 nt, synthetic construct
  misc_feature 1..4105: note = SARS-CoV-2/Wuhan/WIV05/2019__EPI_ISL_402128 spike protein mRNA gc (1-1273)(N501Y_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25193 - RNA, 4099 nt, synthetic construct
  misc_feature 1..4099: note = SARS-CoV-2/Wuhan/WIV05/2019__EPI_ISL_402128 spike protein mRNA gc (1-1273)(H69del_V70del_D614G)
  source 1..4099: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25194 - RNA, 4105 nt, synthetic construct
  misc_feature 1..4105: note = SARS-CoV-2/Wuhan/WIV05/2019__EPI_ISL_402128 spike protein mRNA gc (1-1273)(Y453F_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25195 - RNA, 4105 nt, synthetic construct
  misc_feature 1..4105: note = SARS-CoV-2/Wuhan/WIV05/2019__EPI_ISL_402128 spike protein mRNA gc (1-1273)(D614G_I692V)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25196 - RNA, 4105 nt, synthetic construct
  misc_feature 1..4105: note = SARS-CoV-2/Wuhan/WIV05/2019__EPI_ISL_402128 spike protein mRNA gc (1-1273)(D614G_M1229I)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25197 - RNA, 4099 nt, synthetic construct
  misc_feature 1..4099: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4099: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25198 - RNA, 4099 nt, synthetic construct
  misc_feature 1..4099: note = SARS-CoV-2/Wuhan/WIV05/2019__EPI_ISL_402128 spike protein mRNA gc (1-1273)(H69del_V70del_Y453F_D614G_I692V_M1229I)
  source 1..4099: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25199 - RNA, 4096 nt, synthetic construct
  misc_feature 1..4096: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4096: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25200 - RNA, 4105 nt, synthetic construct
  misc_feature 1..4105: note = SARS-CoV-2/Wuhan/WIV05/2019__EPI_ISL_402128 spike protein mRNA gc (1-1273)(K417N_E484K_N501Y_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25201 - RNA, 4096 nt, synthetic construct
  misc_feature 1..4096: note = SARS-CoV-2/Wuhan/WIV05/2019__EPI_ISL_402128 spike protein mRNA gc (1-1273)(L18F_D80A_D215G_L242del_A243del_L244del_R246I_K417 N_E484K_N501Y_D614G_A701V)
  source 1..4096: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25202 - RNA, 4105 nt, synthetic construct
  misc_feature 1..4105: note = SARS-CoV-2/Wuhan/WIV05/2019__EPI_ISL_402128 spike protein mRNA gc (1-1273)(E484K_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25203 - RNA, 4105 nt, synthetic construct
  misc_feature 1..4105: note = SARS-CoV-2/Wuhan/WIV05/2019__EPI_ISL_402128 spike protein mRNA gc (1-1273)(L18F_T20N_P26S_D138Y_R190S_K417T_E484K_N501Y_D614G _H655Y_T1027I)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25204 - RNA, 4105 nt, synthetic construct
  misc_feature 1..4105: note = SARS-CoV-2/Wuhan/WIV05/2019__EPI_ISL_402128 spike protein mRNA gc (1-1273)(S13I_W152C_L452R_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25205 - RNA, 4105 nt, synthetic construct
  misc_feature 1..4105: note = SARS-CoV-2/Wuhan/WIV05/2019__EPI_ISL_402128 spike protein mRNA gc (1-1273)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25206 - RNA, 4105 nt, synthetic construct
  misc_feature 1..4105: note = SARS-CoV-2/Wuhan/WIV05/2019__EPI_ISL_402128 spike protein mRNA gc (1-1273)(D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25207 - RNA, 4105 nt, synthetic construct
  misc_feature 1..4105: note = SARS-CoV-2/Wuhan/WIV05/2019__EPI_ISL_402128 spike protein mRNA gc (1-1273)(A222V_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25208 - RNA, 4105 nt, synthetic construct
  misc_feature 1..4105: note = SARS-CoV-2/Wuhan/WIV05/2019__EPI_ISL_402128 spike protein mRNA gc (1-1273)(N439K_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25209 - RNA, 4105 nt, synthetic construct
  misc_feature 1..4105: note = SARS-CoV-2/Wuhan/WIV05/2019__EPI_ISL_402128 spike protein mRNA gc (1-1273)(S477N_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25210 - RNA, 4105 nt, synthetic construct
  misc_feature 1..4105: note = SARS-CoV-2/Wuhan/WIV05/2019__EPI_ISL_402128 spike protein mRNA gc (1-1273)(N501Y_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25211 - RNA, 4099 nt, synthetic construct
  misc_feature 1..4099: note = SARS-CoV-2/Wuhan/WIV05/2019__EPI_ISL_402128 spike protein mRNA gc (1-1273)(H69del_V70del_D614G)
  source 1..4099: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25212 - RNA, 4105 nt, synthetic construct
  misc_feature 1..4105: note = SARS-CoV-2/Wuhan/WIV05/2019__EPI_ISL_402128 spike protein mRNA gc (1-1273)(Y453F_D614G)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25213 - RNA, 4105 nt, synthetic construct
  misc_feature 1..4105: note = SARS-CoV-2/Wuhan/WIV05/2019__EPI_ISL_402128 spike protein mRNA gc (1-1273)(D614G_I692V)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25214 - RNA, 4105 nt, synthetic construct
  misc_feature 1..4105: note = SARS-CoV-2/Wuhan/WIV05/2019__EPI_ISL_402128 spike protein mRNA gc (1-1273)(D614G_M1229I)
  source 1..4105: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25215 - RNA, 4099 nt, synthetic construct
  misc_feature 1..4099: note = SARS-CoV-2/Wuhan/WIV05/2019__EPI_ISL_402128 spike protein mRNA gc (1-1273)(H69del_V70del_A222V_Y453F_S477N_D614G_I692V)
  source 1..4099: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25216 - RNA, 4099 nt, synthetic construct
  misc_feature 1..4099: note = SARS-CoV-2/Wuhan/WIV05/2019__EPI_ISL_402128 spike protein mRNA gc (1-1273)(H69del_V70del_Y453F_D614G_I692V_M1229I)
  source 1..4099: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25217 - RNA, 4096 nt, synthetic construct
  misc_feature 1..4096: note = SARS-CoV-2/Wuhan/WIV05/2019__EPI_ISL_402128 spike protein mRNA gc (1-1273)(H69del_V70del_Y144del_N501Y_A570D_D614G_P681H_T716 I_S982A_D1118H)
  source 1..4096: mol_type = other RNA
aggagacccgtgacccggaagttgtacggctacgcgactttccctcccacaaaccctcgcgcccttcctttcctacttgggcccggcagaaagcttaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa
